United States Patent 10,233,495 (METHODS AND COMPOSITIONS FOR SCREENING AND TREATING DEVELOPMENTAL DISORDERS) - sequence listing, part 166

SEQ ID NO: 996 - DNA, 774608 bp, Homo sapiens
gttgaagaaagaggatctggctgaaagacccgcaactttcacttgttgagaacctttagccagcgccggcgtgcatgtgttttagttttattctttttcccttgcccccaaagccgtggagtacctgctgttgctctcatgcctcttgccaacagtggcatctgctcagtgtagccatcaagaatttgaatgtcaatatctttgccttgaaatgaatggaaaagtatttgtcactcagcggcaatcattcttcaaataaaaggttagccagacaggacccttaatcaaagagtcggtcttttctgtcagcagtgccttttaaatagcaatgatgaaggctggctgtcagggtaggacttgatgagcgagatgattgatctgcataaatcattttcttttaacattgtcagtgaagagtaaattggtgggacattttgggtattagctgtgttgaaattaatatgcagtatcctaggtgtgtcctcgatcacatagtcctcataaaagaaggtagaaattaaaaggaggcttttaggcatgcattgttctaacaagaaagttgcaccattcttactgctgtggtcatcatcttgcatgctaaattcggaagttgagtgtgtagcacattttacaagctccaaaaggaatctagttaatttgggaattagctagagtcagtagcatttaacaaccagtaaatctgtaaagacttactgctcagaggcaaaaaaaaaaaaaaaaaaagtctgagaatggtttctggttttataggatagggtatctactacctagcatgctgttgtagaaatagactcagctttagatgaggcttaggcttgaatccacgtgccatccctccaaagtgagtctccttgaccatgatgtaagtattaacctttttgagtctgtttctttgtctctaaaaatgggatttcattagttaccttgggtggatttgcttttggtattaaacagagcaatctaggtgaaagcgccaggcacattacctgggacatggtgagcaagtgctcaataaatgttcatctcctccctttctttcaatcaagcgaaatgccccaaaccagccaagatgtcaagattaaggatatgccctcatggtcaaaataaataatacattgcctggtttgggtcattctgtatttactggaatatcttatggccatttttatgtcaaaaacatatttcagcaaggcagaagcaatacctaattgccgaatactgaaaatagggaatgaggtggaaggaatgggagagaaatatggccagggacacttggtttttcttaccattacactctagattatgtgtctgggttcatatgattaaactctgaacaagtgaaaccaatgcaatatagtgttgggattaaaagtaggactggtggagccagatggctcaattcagatcccagatcttccgcttaatggctatgtgactgcaggtaagagagctaattgcctccctgagcttgtttcctcacctataaaatggggatagtaatagggttatcttacagtgttgttaggatgattgaattagtatatacaaaacaaaacatgtaaaagagtacctggtatgtacatgttaaccatgattactatgaatggttagttggttaagaaaggtagataatgctggccgggtgcggtggctcacgcctgtaattgcagcactttgggaggctgaggcgggaggatcacgaggtcaggagattgagatcatcctggctaacacggtgaaaccctgtctctactaaaaatacaaaaaattagccgggcttggtggtgggtgcctgtagtcccagctacttggaaggctgaggcaggagaatggcgtgaacccgggaggcggagcttgcagtgagtgagcagagattgcgccactgcactacagcctggcgacagagcgagactccatctcagaaaaaaaaaaaaaaagaaacaaaggtagataatgctgaaattcaagtgggtcaacagtctcaaaggaagaaacatatttagatatagaaatgcatgataatggtatactggagtgaaatacttgtttcattttggagaaacttgcctactggaggaattttgagctaggctgattccaaaaacatccatattgaagcaaataggttttgtagggtcttcgggtaaatagcctttacttgctgtgttgaatgtgaaggttaaaggaacacagtcttctctagccagattctccatgcgccttctgtaatggtaaagtccacgtcaatcgctgcttgtgggcgtgtggcatggacgcgcaggagcctctgtaacatgcatgtggcatgcagctgcgtggattcctggagattattggagatttgccttctcttcattcttagagatgtgcatttgttttcctcaacttgcttttagctcagctgattggttgtatgtgagctttgtgctcctctcctttcctgtcttctgaatttatgctattttgaacttttggtctgcttctgcataatgagagaagttggcagaagacaattccagataaaccttcaccaaaactaatggttctgtggaagtccttgaacgggtgtggaggagcaaagctctcccagttcccaggtgagcccagggtggagatgtaagaccacaccgaacactgagcatggtcaccaggctgcttttgagaagcgactgtgaagctgtcctcctgcaggggcatgatggctatatttgagaatttctggaaaacattctctgcctctctggcttgcaatgctcttgggctgcaggagtggtaaaattgtgctgttagattcgttcctgattccatccttattagataaagcgtggcctgtgttatctaactgactacttaatggagtccacattgggtgtgatattctgctcaagattaatttcgggtaatgaagatctgaaacaaggtatttaagagccccactaatgtttcatttatagcaatctatcaaaacgatagatatttagcctctttactggatatgaaacattaacttaaagccagtgctgctttctgtgttaaataccagtacccctgccttcgattttatcaaacattgtgaaaaatctgccaccacctcccggagaacacatatcatggacttagccttaagttatgattctctggcaccttggacaactgaccaaccctagcttgggccctgcttgggccttttcacataatgagtagaattcacaaacaaatatttatcgggcacatgctgtgttcaaggcccactagacattgtgagggggacacaaagtggactcaatttcactgcatgcgatatgctggaaaagagatatcttagcccaaggggcaggctcattactcctaagttggttattacattgttcagttatgagcagatgaggcctagaaaaatctgggtcgcttctcctcataacaacttcccatttggggcggtatgaaaagtgtgggtttccatcaattctgatgagtaggtggagtccattcctcagcctttaggtgctccccattgtccaggagccaacagttgggtatttggggctccagaacaagtatccaggcacctaaatggtatctagctaatatttattgatgcatttttctaaggaaaaatgagcaatttccacttttcattttcaagcttaatactcatgactgtccagtattatccttacccctctctagttttcttctctttactgtttttattgttcattggaaatatgttggtttagtaccaattgtgtgctgttttcctatatggaatatattctttctgatttttttctgattcaaatggtatctattcttcagggcctttctgaagacccgtgtcttcctgaccatattctctgtgcagtttttcttctttccaggaagaattttgtttttcttctctgaattcataaacatcaaggtttgaatatgcatccaatgcttgaacatagatgatggttctctagatatttttttctatgtgtaattcattttccttttaggttacagcatctttaagaatagggacctatgcttaatatctcttccatagcacacacactacttttgggcacacaagttgtactaaaagcctagtgacttgacctggtccacaaggatgaatcctaaatggacttggcagtaattttgtgtaagaaaaggcagaggtatcacacaattgattttacagtgtgtcactctcagtgtagtgcttatgaccaccttggggaatgtgaatgaagcccccactagatttgtctgtgctgtcgccaaggacttaaccaccaggttgctgtttgcagctgtctctgatagtacattggggtctatagacttgagtgtctctatcttttctggctcttccgcatgcttggtggtggttcgatattctgttttgtacttctttgataccgtctctggggtccccttaattgggacaccttaatcggggagcccctgctgcctgggcagggggctgaagtcctgctgctttccctccacattgtcaggattcctgggtgtttcctgggttggagacgtcagcctggcggcatagcctgtgctttccccattacctgatcacgtttcatcagtgaaacgggatgtttcactgaaggcttatctcaggaggcgcctgaatcttatttgaccagaaatctttttggcagttggtgaacttggttggattccagtctgtccctttcattgtcaggacatacccacagtgaggatttgtgtgccaggcgtgtcatttctctgtctcctccagaccccccgccctcatgatactgttgccaaaatcaagggcccaaccccttaccccttaaacatctttgccttttaaattttgtaaacaatgctggaataaaacatttttattataacagatacaagtaatagagatgttgtagcaaagtctgaaggtctctgttttaagtagtgtgtaatagaaaaccaaaataaggggtgggcgaggtggcttgcgcctgtaatcccagcattttgggaggctgaagagggcggatcatgaggtcaaaagattgagaccatcctggctaacacggtgaaactccgtttctactaaaaatacaaaaaattagctgggcatggtggtgggcacctgtagtcccagctacttgggaggctgaggcaggagaatggcgtgaacccaggaggaggagcttgcagtgagctgagatcacgccactgcactccagcctgggcgacagagtgagactccgtctcaaaaacaaaaacaaaaacaaaaattagctggacgtggtggtgggtgcatgtaatcctagctacttgggaggctgaggcaggagaattacttgaacccaggaggcggaggttgcagtgagctgagattgtgccaccgcactgcagcctggcaacagagcgagactctgtctcagaaacaagaaaatcaaaataacagtggcttaaaatgggagttttagtttcttttacaaaaaggaacagattcagcctcttgtgttagcttcctgaggtcaacagagacaaggcttctcctgtctttctgtatcaacatctttagctgtggctttcattttctaagacacttcatgatataaggctggagttccagtcatatcatccaagttttaagcaggaaggaagaagaaggggagaggaaaagaaaaagcacatgctagctagttgtccgtcccatttttatgcagggacttatttgtttacattgctcagcactagccagtcatgtgctaaagccagctcaccctaggttatgaatgccaattgttacatttgccagagtttttgcaagccgattgtcttgagtttggtagcttgaaattggccatagtttttacacaagagaaaatggtgtaagagagagctgtttgttaaccatttacgagacacagctgttcctggctgtaggacaggcgaggaaatgtaatttttaacttggtgcattgccacacagaataaaatcacagtccttttactaaagaagaagggaaagtgataatgaataagaaaacactctttgctacattctccccactttgtattccacagactggatctgcttcccctgtttaggttgttaactcttgtctccttttcaagttatgcaacagtcaacatagttttacatttgtgtttctgcacatgaaccagcatttgtggacaatagcttctttgaggtagatttgctaggtcaaagggtatgtgccctctgcttaactctttataaagaacactcaccagatgtctggtctgtttcctcctaatgtagtgtagtggtgatgagcatggattttggaatcacacatacagggtgtgaacactcattcagacacttctagctgtgtgactttggccagcttacttaacctctgtaagtgtcaatgtttttttccatgtaaaatgggagtgggggataccatctgaccctgcagggttttgtgacgatgaaatgagattgtgactacatagcacttacagcagagcctggcaggttgtaaacccacagtaaatagttagcaggggcttctgctcatggaaagatacacatgtgtgcaacatacagtgagaagaatgaaaacatgaaactgggccttgaacattacatgtagggtcgatatgagttgtagagatgaccagattcagataggaaagcaatggatgtttaatgttcaaactggaaaattattcatttcactgcccctaggggtaggtgtgtaagctaattgatggttagaaaaatcccagagtaaaccaggaatgtctctaattcataagtgtatattataaatatatttaaaatcatctttatgacaattcagttatgtttctttagcatatcagatcctttagttgtggaacttgacagaaatcaacataaatgttctttttctctcccaactatattgaacattgcacagatgtgtagttatttatcatgaacatgcaaatattgatgtccccaaggcccattctttgaatttcaaactgctgttgctatatttggatgttgattaatacgagtctttgctctgacacatagcatgtctgatttcaggacctctgaaagcagcatagagaagaaaagagaagctgaggcttgatattcatagggatggacaataattgaagacgtgaattgctttgggaaaatggcagcaggcaaccaaatatacgagatggttaaggatatgcctagcacagaactttgagcaggtagattttcagtatatctttgctcacttaaagagacagaagctatggagaagaaacaatcacaatgaaagaattattttaacactagtctagaacaagatttcttaatcttggccctattgacatttttggctggataattctgtgttgtgggggccgtcctgtgcattgtagggtattgagccacatccttggctacccactagatgccagttgcatggccttcctcaagttatgatcacaaaaaatgtctccagaccttgctaaatgtctctgggtggagggcagattcactcccagttgagaactactgatctagaagaaaggaaaattagatgatataaagtaaacaacaattatatgctagacatttaacccattgagtccttgcaacaagcctgaattgcagatgttgctaaaattatttttgtggaaagagaggtgggattccaagaagctaagaacatgaccccaggtgggacagatgggatctgagtccaaatgtgatgttcttttccttgtattcctctccttcctaactgtatgacataaacgtaaagtatcacaagagcttatgctgctcctcttcttggtaccaagctcggccttcactttcttatgaaaaccaaaagcagttttcaaagaatcatgcacaacttatatttgggtgattgatctgatttggcatacattttgtggagaacgtgaaccagtctattccccagtggagggctgttgataaacaaagagatatgtagtctttttagcatttcaagggctgtgagtctcctgagaaaactcaaaccaggtccaagaggagttactttgagacaagctatctaagaactgcaatatcctctgtggggaaggtggctttcgttgtaatggttcttgcaaatatttcttaaaccaaatagggttttcttctggggaacactgagatcaactatttgcctatttgatcctcttgcagttaatgtaacaggtttaaaactctggtctcagcagaaggggcttcattccgagctatgggggctaattctgtgcagtgcagtgtggggacagagcatcccactttccacagtttggtgaggcactggcccttagaggagagtttttgggtatacagctaattgttctaattatgtagtagtaaaaatcataccgtcctgtagccgcatatgaatagtgcactagagtgctttcttaaaagagttgggatggggttgggagggtcaggaaatgaagggataaaattattgttaattccacccccttgttataccatcaagagaatagaaaccaataaaagaactaaatgttggcaatccataaaattccataagcagtaataaacaaaagctgaaactgtattgatatacaaccaaacaaggaaattatcattattttttaataaagccatttatcatcaataaataccaaggggaataggaaaaattacaagcacaatgccatcttccataattatacctattaacaatttaaagcataattatgtgagggagaaaaacttttaggaaagctttgtgctgttttctccacagaaaagtcaaattctcacactcccagatattcaggattttctaaacatttcagaatgattggttatgcttgtcccaacttacagtagcttattttctaaggatctttctaataattcaggcccttccggcctctccattaccaggtttgtcatcagccctggagaaagggctgggattcaggaaaaaggtatatatggtaatgatctgaccgcttgctaaatgtcactggtcaagaggactttgtttagtgacaagttgattttgggattccaggatctttttttttttttttttttttgagatggagtctcactctgttgcccaggctggagtgcagtggtgctatctcggctcactgcaagctctgcctcccaggttcacgccattctcctgcctcagcctcttgagtagctgggactgcaggtgcccgccaccacgcccggctaattttttgtatttttagtagagatggggtttcactgtgttagtcaggatggtctccatctcctgacctcgtgatcccccgcctcggcctctcaaagtgctgcgggcgtgagccaccttgcccggccccaggatcttacttattttatctgaactaaccccagctgagcagctgctattgcctaaatgactatgttccaggccttggggttacagaaataaatgaggtactggtgtttgtttgtttgtttgtttgtttgagatggagtctcactctgtcacccaggctggagtgcagtggtgcaatcttggctaactgcaacctccgcctcccgggttcaagtgattcccctgcctcagcctcctgagtagctgggattacaggtgcgtcccaccatgcctggctaatttttgtatttttagtagagatggggtttcaccatgatgtccaggctggtctcgatctgctgacctcatgatccacccatcttggcctcccaaagtgctgggattacaggtgtgagccaccgtgcctggctggtgtatttttttaaccattgaacaccttacattcccaaagggaaacagacctgtatgcctgcagtggcgaacagcagggtgatttaagagtatgcctcagagcccaccagccagcctggggtcatagccctgctctgaagcttatcacttatgggaacttgtacaaattaattaatgttcatatgcctctgtgtccttatccacaaaagaaaaaatagtaataatatctgcttgtaggttgttatgaggactaaatgagttgatatatgaaaagtgcttaaaaaactgcctggcacctggtgagtgctatgtaagttggcagtcatttaacctgacagggtgaagtcctgtgacttggtactttggttctggtatgatagcagtggttggggtattttgatagtttgggtctggtgcaatagcaagctcgtggtcacggaaggctctgtgtacaagagaatgactgtcctgagtcttaaagggtgagaataataggagagagtattccacacagggaaaaccacaggagcaaagggatagcatacagaaacagtatgatgtgcctggctctttataagctatactccatcttcttagagcctgacacaattgagctggtggcagagagagagaggaggctgcagtagctggcagagtctggtcacagaggcttgagtttttcttgaggacaggagggccctgttgaaggatattcactgtgaaggtgatggttagtcagatttccagtctagatccattaggaaagcagtgtactgggttgctctaacaagtgagaggggagccgaagggaagggttaggggcaacttttggaatttttatgattcagacttctacccagtaggacaatatttcagcagggttatgcatgtttgttggaaatgaacacctggactgattgattctcagtttaattgtggtagtcattagtgctgtttggcaaatatcccagttctccactttcaggcacatgtataaacaaatggtaggattgtattttctggtccccttgtgtgaatggggtcacatgaatagttcaggtccaggagttgtaagaaaagtgatatgttactttgtaatcatatcactgagttgttgctgaaagatctttcagagcttgctcttttccctctgtcacagtgactagcatcgttccagatagagttggctccatcagctgggtcctgcagtacagatgacatggagcagaactcccagctgactcttgattaacatggagcaggagtgagaaataaaccgttatggtttttaagccaggggtcagcacactttttctataaagggccagatagaaaatattttaggcttttagtttatggaccatgcagtctctgtcacaactcctcaactctgtccccatagtgggaaaacggccataggaaatatgtgcacacatgggcatggctatgttccaatcaacttttgtttacacaaacaggcagcaggctgcagttgaccagcaggctgactcctacttaaggcactatggtttgggggctatttgttaccaccacataatcaagctattcctgactgatactttgcccaactagcttttctttttaaatacaggtaaaatttacatagagtgaaatgcacagatcttatgtgtgttattcaatgatgtttataaatgatgctatgtgatgtttaataaatatatacatattaagtatatgctttattatgtatcataaaactatcccattttatgaatatagaattcattttcttgttgatggaaatttggactatttatagcttttggtcattatggataaagctatgagcattcatgtgaaaatctgtgtagatctagatttttatttctcttggataaatagctaggagtataactgccagatcctggagggggtgggtagatgtaggtttaaatttatgaaaactggccaacagtttttcactgtgattgtgccatttatacttccaccaggaatgtttgagagttctacctactctacatcctctccaacagttagtgtcgtcagtcttttgactatatttattctattaggtatgaaatggtatctcactgtagttttactctgtgtcttcctgatcactaatgatgctgaatgtattttcatgagtttactgccatttgtatatcaacttttgtaaacagactgttcaagtattttgaccatttaaaaaattgatttctggtcctaagtcctttgtcagatatctatatatctacatcctatgtctatatttatttatttcaaatttttcttccagtttttgagttgccctttcacttcttaaatggtgccttttgataagcagaaggttttattttgataaatacctatttatcattttttttttttgttaatgctttctgtatcctaagaaacctttgccttccttggggttgtgagatattctctatttctttttattaccttgagttttggcttttatgtttaggtctttgatccatgttgaattaattctcgtgtaggagagttaagaattgggattctggctgggcacagtggctcacacctgtaatcccagcactttgggaggctgaggcaggtggatcacgaggtcaggagttcgagaccagcctgaccaacatggtgaaaccctgtctctactaaaaatacaaaaattagctgggtatggtggtgcatgcctgtaatctcagttatgcagaaggctgaggcagaagaattgcttgaacctgggaggtggagttgcagtgagccgagattgcaccactgcactccagcatgggcgacagagcaagactctgtctcaaaaataaataaataaaataaaataaaagaagaaaaagaaaaagaattgagagtctgtgtgtatatctagttgtttcagccccatttattattttcaactacactcccccattcaattattttggaaactttatcaaaaatcagttggccatgaatgtgtgggtctattattgtgttatctgctctgttccattgacctatttttctacctttatgcaattaccacactgtcttgactactgtagctttatagtaaggatttaaattaaggagtatgagtcctccaaatttgtatttcttttgaagcatctttcacctgttctttgggtttccatataaactgaggtcctttgggtttccatataaattgagaaccaccctgtcaattaaaaaagcctgtggggttttgattgggattttattgactctatgaatttgtggaatgttgatatcttaagtttttcaatccataaatgtattacatctttccatgtattcaggtgttttgtgtttttttagtggaggtcttgtacaactttagttacttttattattactttgtttctgatgctattataaattgaattaaaaaaatcattttccagttctttgcttctagtacatagcaatattgatttttgtatattaactttgtatctagcaaccttgctaaagtcacttactacttctagtatttggtttttaaattcatcaggaggttttatgtaagctattacattgtctagaaataaaaagttacttcttcccaattttatgtatttttttcttgttcttgtcttattgccctggccagaggttccagtacaatgatgaacagaagaggtgagaacagacatctttgcctcattcttagtattagaaggaaagtttttattattttatcatatgtattatctttgatgtagaagttcttacatgccttttatcaacttgaggaagttcccttatattcctagtttatcatgaatgggtattgactttttctgatgcttttcagcctctattgattatatgggttttctcctttgttctgttattaataatatggtaaaagcaatttgttgattttcaaatgttaaactcaccttgcagtactcagatgagcatcacttggtcatcatgtgttatcctttttgtatatttctggatacaatttgataattgttattattttttgagatagagtttcacttttgtctcccaggctggagtgcagtggtgtgaactcggctcactgcaacctctgcctcccgggttcaagcgattctcctgcctcagcctcccagttagctgagattacaagtgcctgccaccacgcctggctaattatagtatttttagtagagatggggtttcgccatgttggccaggcttctgttgacctcaggtgatccacccgccttggcctcccaaagtgctgggattacaggcatgagccactgtgcccagtcaatttgataatattttgttaaggattttttagtctatgttcatgataaaaaattgtggtaattttcttttcttgtaatatttttgtaagatttagggataagggttatctactggcctcaagatgaattggaaagtgttccttcctcctctgtgctctgaaagagtttgtgtaattttgggttttttttcttaagtttttgatagaattcaccaatgaaaccctttgggcctgtcagttttctttgtagaaggttttaaaaattattataactttaatttaataaatatagggtgactgaaattttctatttcttcttgtgtcagttttgttaagttaatttttcaaggaatttgtttacctaaatttttgaatttattcgcatagaattatttatagtgttaccatattatctttttaatatctgtaggctctgccattataccatttttcatttctgaattgttattttagaatttttctcttaactaatcttgctagggggttgacaatatttttagcagctttatttgaggtacaatttgcattacataaaattattttaagcatgttcttcagtgatttttttaaaataaaatcatatagttatataaccattaccacaatccaatattagaagatttctgtcacccttaaaatcccttatgtccatttgccgtcactctctattcctacccccaactctagataaccaaaacaagttactgttacaattgatttgctttttctagacattccatacaaatgaaataatacaatatgtggtgttgtgtgtctggcttctttcgtttagcataatggttttgagattcattcgttttgtggcatgtatcagtattctgttcgcttttattgctccatagtgttttattgcatggatatagcacatttagtttgttcatttgtcagttgatgatgaacaatgctgccataaatattcacatataagtcttgtgttgacatatatttcacttcatttggatacatacctttgagtcaaattgctgctagactgaattctaaaatgactgcatcttacatttatgccatcagtatatgaagattccaatttctctacatccccccaacatttgttagtgagtatatatttttattttagccattctagtgcatgtgacagtgtatttcattgtagttttaatttgcatttttctaatgactaataatatagaacatttccatgtgctaattggctactcatatatctttttttcaaaaaacattcaaatcctttgccccttttaaaaattgaattctgtttttattactgagttacaagtgttccttgcatttttgtggatataattcctttataaagtacagtatataatttgtaaatattttctcccagcctgtgggttatcttttcatttttttatggtatgttttgatgtgcaaaagtttttaatattggcaaagtccaacttaaccactttttgcttttatagataatgcttttggtgttacatataagaaatccctgccgaggtcatgaagatttctctcctaagtttatcaatattattaatatttcaaaagaaccagcttttgcctttgttaattttctctattgttagtccaatttttatttcattgatttttcttctttttacttactttgctatttttctagcttgttaatatggaaacttgtgattttaagcttttcatgttttctaatataagcatttaaagctataattttttctcttaactataatttgcgctgcatccatggattatgctatgttgtgtttttattaatgtaacattaaaaatgttttaaacattttcttgtgatttctttttacatccctgatgttttagaagtgtatagtttaattttcaattatatgtgttttctagatatcttttttgtcaagttctgactttattctattgttgaccctgatctgatcactatatacattacatgttttgaagcatcactatgtgctccatgaatatgtaaaatggttgtcaattaaaaaaacttaaaaagaatttaatttagatatttattaggacttattttaattatcattatggcatatggtctatgttcatgaatacatcttgtgtacttgaaaatgtgcattgtgcaatttttggatatagtgttctaaaaatatcaattagattaatttattcagtagtgtgtccacatctacagtatctgtactggattttgttttattaagagtttctgtgagttctgagagaggcatgtttattctttatccacaggcatgtttattctttaaccacaattgtggatttatcaattttttcttttacctctgtctagtttttgtgtcatctgttttcaaactttgtatttaagtgcacacatatttatgattcgtatgtcttcctgattatcatcatgaaacaccatgtttaaacctctgatcatagtctctgcctcgaagcttactttgtccaatatcagtgtagccataccacttttttatgtgtactttttttgcagcctatatatgttttttatcctattactttcaacctaatttggtatttatattttaaatgcatccttgttgattgcatttagttggatcttggtgttttattcagtctgataatctttttctttttttttttcttttgaaatggagtcttgctctgtcacccaggctggagtgcagtggtgcaatctcggctcactgcaacctccgcctcccgggttcaagtgattctcctgcctcagcctcccaagtagctgagatcacaggtgtgtgttactattcctagctttgtgtgtgtgtgtgtgtgtgtgtgtgtgtgtgtgtgtgtgtgtttagtagagacggggtttcagcatgttgaccaggctagtcttgaactcctggcctcaagtgatccgctcaccttgatggagtttatgaaaactttttgatcagcatgttgtttttttcccaaattgaagggaatttttgtccgttatttgttcaaatactgtttttgccttattattctcaccccgattacacataaattagatcacttgatatgtttgcacatttgactgtaattctgttattttgttttaatcttttttctcctctcatttcttcagattggataaatattttgacttcttttcaagtattattgatctttcttcaagttgagtggtccttttttcccccttgacatttccatttgctgttaagaccatttatcaatttcttcttttacctctgtctagtttttgtgtcatctgttttcaaactttgtatttaagtgcacacatatttatgatttgtatgtcttcctgattatcatcatgaaacaccatgtttaaacctctgatcatagtctctgccttgaagcttactttgtccaatatcagttgtagccataccacttttttatgtgtactttttttgcagcatatatatatattttatcctattactttcaacctaatttggtatttatattttaaatgcatccttgttgattgcatttagttggatcttggtgttttattcagtctgataatctttttcttttttttttttcttttgaaatggagtcttgctctgtcacccaggctggagtgcagtggtgcaatctcggctcactcaaacctccgcctcccgcgttcaagtgattcttcaagtgaatttttcatttcaaatattttacctttcaattacagaattttgtttgatgcttttttgtagtttcaaattttctgctgatattcccctattatgactctctttccttgaggttcttgaaaatatttattataacttttttaaagttcttgattcctcattcaaacatttgggttatctcaaaatctgtttctgttgcctgatttttcttttgactgtgagtcacatttttatgtttctttgtatatgtagcattttccattgcgttaatatgttgcaaggattctgaattctgttatctccccctgaaaagttaagacttctgttctagattaatttttgcacctactggctgactaccttgaacttgggaaagtttgtttgtacactttgttagggaagctctgtttcaattttgcaattgatcttagtgtaaatttgtaatcctaaggcatacctgcactttaaggtgtcttccttcaggagttttcatgcaaagcttaaaatatttaccaagcgccttcaccatgtcagaattaaaactccagaccctgactttttaatgatggacagcttatgaaatatttggtagctttttcagcctttcacctgtttgtttctgccagactacttggacttccctcaagcatctactgttcagggataagcccaggatttgtgaggagatgtatgcagatttcctccctctgtcacctgttctgttctggtatttcccttcacaatctccaaccgctttggcatccctgacatctggcttttcaaggcagtgagactgaagctttttcttgagttctggctgctgtgtccagtgcagactctggagtggcctcaaggggaaaagccatttaaacatagatatcacccaatatggttctcttctttcaaggccattggattgtcttctgtttctgtctgcttttggtagctttccagtgccttctattagttgtttatatttttccaagagtttataatttttaactctttatgcatctgcctcctacatgagggtctagggaagagatctccaggtggaggaaagagcaaatgagaagccctgagcaggactgagatgaatgagctggggtggaagctggaggcccatgggctggaatgaagtttacatccagggatccctctaagccattgaacttcggcatttgctctgagtgagagataaggagctgtcgaatggcttccttagagaaaaaatgttatctaattttttgccttgtactctaggaaggcaagagaagaagcaggtagaccagttaggaggcagttatgactggtaagagatgatgatgattgatctgggtcaaacaaaatgatttgttgagagcttcgtatgtgctgtgtatgatgctacccacctaagctaagcagctgtgttcccaatctccttcttgccttggcaggggacacagcttgaggactctcttgctacatagaaaaacacatgaggctgagcatggtggctcatgcctgtaatcccaacacaggcatgctgaggcaggaggacttcttgagctcagaagttcaagatcagcctgggcaacacagggagaccccatttctacaaaaaatttaaaaaattagccacatatggtggcgtgtacctgcgatcctagctactgaggagcctgaggtgggaggataacttgaacctgggaggtttaagctgcattgagctgtaattgtgccactgtacttcattctgggcaacagagagagaccctatctctaaacacacacacacgcgcacacacacacacacacacacacacacacacaatagggaaggaaacttgattaaggaaggccggtctagcataaagctttgggtgaaggatttacttgtgtgtgcatatagccacatacctagctgtgtaagtcattacaaatgtcacctggctaatgttcattaatgattagctaattataaagctgccgttctgtccttggactgatagctggtttgttttacagaaggcagtatctttggtagagttgctttatcatatcaaaaagggtagtgttgttttttttttcttagcaatagcttcaagaacgaagaagattaaacaaacactatcgaatgaaagaaccaagcccagtacctggcacataataagtgcgtagaaagcattacttgaaattagatttactgcttttttgattaaaaaatactcttccaatttaatgtcttaagggttctctataaagagtacaaattataagttaaataaacactatattggaccaaaatcagaagtagaaacttgcataccttctcttgatttgttaattactgagaagttatttgtggtcttgacctgatgcatgcattaatacattatgtgtgtgtgtgtgtgtgtgtgtatatatatatatatatatttttttttttttcttagctccctttacttctaccttctctctttcactctctccttcctcccattcctcctatcatttattgaggactaaccaaatgttctagtcactgttctggcacttgacgtgcagagcctcctggtagccttcagtttagtgcagtgattgagagcacagcctgagagctggacccatttgcattccagcccagcctcagccccacaagctgtgtgatcagaggcattttaccaaacctttccaaggcttggtttacttatctgtcaaatgaagatggtggtgcagttttcaggctgcaagtgagtgtgtaaggtcacttagctcataatatggtgacacatttcacaggtctcatgatcagatgaggaagcacatagtatcattcggccttttatacaggtccactggttacctgttcttggtaacagggtgaaggctggggtaacaagtcctgccgggagactgtaagaggttgcatggcactgtgggtcagagtagcatggatccagaccgcctgcatgtacattctggctctgccacttattagctgtgtgccattgggcaaattatttaacctctctgtgtttcagtttcctcacctgtgagatgggttagtaatgctacctattgcatagaactgcagtgaggatgaaatgagttgacccatgcagagtccttagagcagtgactggcacttagtaagctgcatagaagtattgtctattaatacttgcattgattgtgaaacataatttagcattgctaagaggctgtcttttcaggagcatggagtccaagtgcccatttcctgtacatttggctcagatacccacccctaaccactgcacgcagtctcttttctgtctgagtgggacacatctctttcccctgcagcacaatcactctgcctcccgctccgtcctggtctgccatctgctgacccattcgctgctcctgtcacgtcaaagatagcgtggcctttgtggagtgcccaggcagcgtgtcatgtcccagcgctgttgtacatcttgtttcagagatattttgctgtaatgttctgtgaccttttccattgagtgaggtagttggaaaggcactcagtaagggaaaattgagctgttttattcctccccaaggaggctcctgtttcctttccaccattcatttgaaagctatcattttcttgattttatagctgaaaaacaccattgattcactgggtgttagatgctaagagttctcctattgacatgcctattgacagttttcagtatattctgcatctaattatcactcttggctaaatgatacaccttgtggacttgagcgatggagtcgatagctctcaccacattgttctagtgctgcctattgagcctggtgtcacggcgatgtgatttatgtgatcagaaagaaaattcctgttggtgtgctgcataattaaagcaagcgcagagtgactggtgacaaaaaatcaggcctgccgatgtcaccccaaatgaggagagatttctagagtaagcagctgtgacagtgaagaatctctcttggcatcttctgctttgcaattttcaagggttcgattttcctcctggccctggctgagggctcctcttctctcccttcctgctgcattgtggtcagagcttcagtacctgtgtgctgccattccgaggcctgggccgtggggcttgctctgggaggggctcattgttgcagacaggggctgttcatagaatttgggctggcagcagcccacatttgcaggtagggaagatagatggctctaaaatggcttgtcctttgtataagctgttttgagtttctgaggttgagattaaatgttgggaaggccattttccctgtgcatgagaggagtggtccctgcgttgacatggcgggttctgagaggagttgatggtggtgatgctggccagccttaggcaggactgaagtgcaggtggctgacaggtggcaaagactgggcatgtagtaagcaaacaaccctggtgtgagacagtgttccctgtgaatcccaccttctgcctcaactactcctttaccaacactcttcccagagggtcttcagaagatccgcgcagtcaaggaccttgccttcttcaatgctggtgtggcgatgattttctgtgaggccagagtcaagtgatctagcctccatagactagtgtgttctccatatctgaagtgaacggggttccttttagccctaaagtactgtggcttagtgagttggggcttggaataagggttggagaaagtaatggtgttcatctgagaggtcccctgaaggaattcaaaggccaagctgccactgcctgagaggagtgcttcgtgtgtgctgctgatctaagatgtggagcctctggcttcgtatggcactgaaggaaccttggaggttagaatatgttagcgagatatttaatgagacatatgaacagaacatctgaatcaagccaacagagtagacatttccaggcacctgagttgggcaatgaatttggcctggtggctagcaaaagtcatgagtagaatggggattgggtgttggtgggtggtttgggccatgcaaaggagtcaggattctgagattttgggtagctgagattgtgacaagagggacttttgaggtcagtgattctagatgggttactttcctggaagccatatgccttgtgtgggcactattactatcaatttctacttaatgaacctctgtatgtggcacttttggggttcagtttttccccatgcacaaggccagagagattttgtgacttgagttcccgttttcatcattgggattttttaatataaaagttttgagactactcagtgttgtatttttgaggatatactgatactttataattaggggttgtgttaggccattcttgccttgctctagagaaatacctgagactgggtaacataagaaaagaggtttaattggctcatggttctgcaggctgtacaagcatgacatctgacatctgcttggcttctagcgaggcctcagggagcttttactcatggcaggaggcgaagtgggagcagcgatgtcccatggcaaaagcagggaaagacagagaggcaggggggtaccacacacttaaaccacctgatctcatgataactcttactcacttttgagaggacagaactaagctgtgagggatccacgcctatgacccaaacacctcccaccaggccccacctccaacactggggattgtaattcaacatgagatttggatggggacaaatatccaaactatatcaagggcccatagtgctttgtcttcgacactgagtgaaccatggaatgcgtcagcattcttgagaattcatatctcttgtactttgctttagttgttcatgtttatttatctggactagttctgaaattgtcaatgattctgggtaaggagagatattcctctgtaactgtgaaggacctttgaacattctgataggattaatgattttcttccagtgtgtctgtaataatcactaaacatgtctctgtgaagactccttagtacattaaagtattgttaatgcaacagtaccaccagaagactctgggtgattgatcgggataaagttgatcatctgtctgttaaagttcttttttttttttttccattcttgacaagtggttcaacttagaaatcccgagtaccccttacaaattgcaggctacctcaatcacctgtgattacagaacatggttggtttgctgtgtgctaggacccccatgtcttaaccacagttgatttattttaaacactggaaattgcaaaaaaaaaaaaaaaaaaccacacacaaaaaaacctaccttgggagttctttgaccccacagttcttcctattctatgtcttaggctcttaaagtgcttctcctttctgcatctgtctttccccaattcagaaggtacttcccgctggcagaggcatcactcagtaaatttcagggtagcataagaattgctctggttacgttgatatataatttaattttccccagactgcctctggcctctgcctgtttaagctctggaatccctgtggggggtgagtgtgcagaatatgttctcacctctcaattcattgtgactttagctggaggtcggtcctgttgctgttgttgctctgcatcccagcaagtagaagcagcatgtgagatggagtgagcagtaggcatatggccagggtttgtgtgtacagagggatgcagcacagggagggaaagcagcattttccctatgggactgtcaagagaagtcgagcccttccatggagcacagaggcacagagaatcagacagggcatgggcctgggcagcctgaggcctgcctggtgagcgatggggcaggatggctcacatcgcctagccgttggcaaagggtctaaaattcagtgcttcccccaagcagcctagctccttcaaatggcaaattattatttttctgttcttttctgtcttcgggattgtatttgcatctcaaatgtgtgtaaagggaattttgcacattcgacaaacttttactttaaaggcagcaggttggagaaaggagctccatcacattaaatgctggctattgtgcttttcattcagcttgacgaacagtggccgaaaatggcaggggattaaactgatgtaatgacaagaattcatataagaggctgtgggaatggggcagaagaatgctgaggctttgcagtattatggtgttctttgatctgccgtagatggaaaacataatgtacctgtatttatgttgattctaaatagggagtgtgtaaacagaggcatgtcattttccctgcagccttcaagttgaaattacacagctaccatttctgagcaatggacatatttctgagtaatgagttaaatgcagtttttgaatatttggatcttattgtacatcacaataagagcatttttgttgctcaattgggttcctgttacagaggcacacagtatgtgggcatttgtggattattcatttgctaaagggcattcttcttatttttaggaaaattcacctttgtcttggggaatttaagcaaaaacaactgcaatcccgaatagaatgaacacctccttttttcagcctcattctttagtgtgggagagccgcagatgagatgtccctgccttctggagaaatacatatgtgtctttcatctgggaaatgtctttctgggacagcaccagctggaagatgtcacctgggatgaccaaagacttgatcaattgacaaggggagcatcaaaagtggctgagaaccatttatgtttactgtgtttgaaagcactttggagggcagggcgtgcgtctcgtgcatctgtataatatgaaagcatgttttgtgaggcacatcttaacatatggttccagaaaaaggaaggtggtgccctgcactcaaactttttcttttctatacatagctagaaagtcatctttctataatcatttgaataatgatgttcacactttttttgttgttgttgagatggagtctcactccgttgccaggctggagtgcagtggcgtgatctcagttcactgtaacttccgactccttggttcaagtaattctcctccctcagcctcctgagtagctgggattataggcatgcaccaccatgcgcagctaatttttatatttttggtagagacagggtttcaccatgttggccaggatggtcttgatctcctgacctcatgatccgcccacctcggcctcccaaagtgctgggattacaggcatgagccactatgcctggcctgatggtcatactttttaaaggcttcatgaggaatttccctaatttcttagaatactgctttggtcatctccacaattatggtaggaaaatgtggactcaaggccatccacagttttgactgactctgctctgcacagaagcccctgggccagaatgtctcacctgccattagttcccatcccagcctcacatttgtgcctctatggaggctgtgccttctactagaggggcccacccttgctggcttctgcccactagctgctgcccatcctctgggggtcagcttgttccagctcccccaccaccttccctgcaggcttcatagccacctccccagagctgagtgtgtcctgtcagtagcactcggggaggatcagccaccttgctgccaggtggcctctgcatctcacctgttgcactcttagcgtcagtgatggagggtaataacactaatgataatggtaataataaaatcatttattcagcctgcttttactgattgcctgttgtttgctacgggtgaggatggagtggtcatcaaaaagcagacatgggccaggtgcagtggctcatgcctgtaatcccagcactttgtgaggctgaggcaggcagatcacctgaggtcaggagttcgagaccagctgatcaacatagtgaaaccctgtctctactaaaagtacaaaaattagccaggcgtggtggtgtgcacctgtaatcccagctactcgggaggctgaggcaggagaatcgccttgaacccaggaggtggaggttgcagtgagcctaggttgtgccactgcactccagcctgggtgacagaatgagactctgtttcaaaaacaaaaacaaaaaaagacagacatggaccctggattcatggcacttcatgttccagtgggaaggatagaccaaccagtagtcactcacgtcagtggaaggatgttgactgacaggtggtgcgtgacactgtgagggcttgcaaaggggcatgtgaaccattcaggaggtcagcgaaggctttcctgaggacagaaccagctacataattttcagagtccaatgctaaatgaaaatgcagaggtccttgtttaaaagttattgagaattttatggtgagtggtggcagcagggtattaaatcaactgtggggtccttctgtgcagggggccttgtgtggctatgctggttgcattctcatgaagcgggccctgcctgaggagtgacatttgagctgagatgtgaggggagaagagggtaggaagatggctccaggtggacgaaacagcatgagcagagtctctggcaggaaggaggttggcacattcagaaatgatgaaggggccagcgtagctggagttcagagagcaggtggggcatgacgaggccagggcagtagagttggtgatagggaaggcaaagcagaaccctacacagctacttaagtgtcctgagcagggagctaaagacactgggtttggattttgcagtcacactggctgcagtgtgcagggcagactgggtaggtagcaggagcgaaagcagggctgttcggaggatgtcagagctgtccagttgagggagggcaggggctagtccagagtggtgccagtggagggagaaggtgtgcaggaatattgaggacacccaatattgggcatagtggagctgaaggaacaaaagacgccaaagatgacatctagattctggctttgaacccctgagttgaacctcatgaaatcaccaacattctgccacttttgatctgcagaaataccaatttcacacaacttgttctgatagatgggtggttggtgggacatccctttacacgggaatgcttagaggatcagaggggtttgctttgtttttgctttggtggtggcagctatgagagacaattacaaactgggttctagacacagtgagcttgaggtgcctttgcaacctctaagtgagggtaaggaaagaggtggactatatgcatctggagcttagaggaggtgcctgagcaggagatacagttgttggagcagatgctgtatagacaccttatcagggttaccctgtttaaaacttgcaaacatcctgtaaagaatgtactattgtattcagtttccagatgagaataatatggctaagagaggttaattaacttgcccaaggtcacacagccaccaagtggaggagctgggtccagggcccaagctcctaattactgtgcctactgccttctcagtggtttcctcacatcaggatgcacagctctttgtactgagtagatccttaggaattccttattggataaatacatttaaaatatttggtggaaataatgatatcttcccttcttaataggagattcttgaaagaggtcccaaggccccaaagtgtcagcaaccatagatggaatttacatggttgcctgtctggttattctcatcacactttcctctccttcatgggcaagctccacccccaccccttgctgaggtctgaactttgtagagagcctcagttgtggtcatagcaacatcttgcagatgaatccattaatgataagttaggctcctcctctagtattcttggggtgaattttataggattttgacattttagggctaacagctgcctcaggtgctgctgcgctccctcgggaacccctagggcacattactaaatcttgctgggcctaggcacggactcaggatccttctcaacatggtactcatctcattttaggactgagggcactgagatccagagagatgttacttcaacaatcagttaatgctagaataaatctgtttgcttattaaatcaaataaagtagattctagttcagtccttttacaggtaaggatgctgagggcccgagaggcagtgacttgctcatttctggtggagatggagctcatgctcccattcctacctcccatctagtcagtggtccctccttgggcctggaacacacggcaaatccacttgctgtgttggctcattcagcaaaacggagcacatcttgttgtggacatgcatttttcatcagctgttcctctggaacttccctcatcatgcttgtggacagtgaattgaatgatgtgaattatactttattaggattgccttttgatacaagtatttcttttaggctgctttgtgcccgctgtgatgcccaccctggattttcttccctttgcccttgacgttgaagtgaaacatattgtttccctttagaatgccattaaaagtcgatgatgacctttacagtgactaatagtttctaaggggctttaattgtgattttttttttttttttttttttttttttttagcagagcggcattagtttgcttcatatgtcttttgtatcagggaatcaataaaaactcctgccttttgttgatgctataggatattttatgccgatgacaagggatttgatttaatattctctttaaataagatcaacactgctgcagttataaactcttcgaaaaactgtcaagcccgtcaatgtagcatgaaacaaaaagttagcagcctggtataaattagcacgtacaatgtgtctttgggaagggtggtacatatttacgattgtgtgttaaaatatatatatttagagatttctttctgctctttcgaccataagtgggaaatgcagagaggaacatttcattaccaccaccttccaaaccgcaaactttctttgccagttaatgattttctggggcaattctgaacgtggtgacatgatataaacaggtatttatgatctgtgatacaattcttcgtgagtatggatttatagttaaatggtgcagtgggaatccagccagagattattgacagagcttctagaatccatattttgtctgtttccattattcacatacattttcttttgagttctgattatctgtgtagtctgtgtttcctggtttacttgagaggtgagcataagactttgaaattcaagggcatgtgttctatatgcttgggggccatatgttctgtacatcttgaccctgcacctcttccccaatatcttgccattttcattcaacagcgattaggttatgtgattagatcattccatctctctttggctttgtcccagatgaaccaaagtaggagcagagctgatggacaagaaatgtttggggtgagcacatgggtacagtcgtggcagtgtcagagacctgggagagtccagagcttcctagatgagagttacacggctcctgggacaaagtgaggctttttcagaacagcagcagacaagtgagggatcactcacgggcaatgtggatcatgttagcaggataggaatggataggcaagagtctgaggggcggcaaatctgagatcaggtgatccagagagaaggtctgccttgcacactgggaagattgcagtggagctgctggtggcatcaggagagccctgggaggtcactgcttccatgactggaggaggtccactcagagttgcttccagtgccgacccacggggagaaactaccagaccagagtttcttgaagtatcttccctggagggtctacatcttaatcacttgggatttccatcagaatctgttgtgaggaagctgagaatctgtattttataaagctccccagctgatttccatgcaaaccaataaagctttgaaccatcgcttcacacttaaggagtctttccaagttagaacaaacttaggtctcctttcattttttccgaaagagtttgggtttatatctggagagagagtgatgctctttggacgacgtgggacagatacgcgttactccacaggtccatttgagaaagtgatatttgccagaaaatatacaatatatgttttgtttaggttatatttgttgtattatagatacaactttacatgcagtttcagatatccaaattccctgatcgtgaactccctgttgaaagctcttggttggaagacagggttatattaattcttgctacctttcactgattaccctatgcttgctctaaccatttgtgttgaagacaggatcaagatatgacctctagttactgtcctagaaaaatctctgctgggtcaaaatgctgaatcttcattatgctaataaacaccttgatgaaaatcgaagcatgtggtccccattccagccaataaatccatttgtcactattggaaagcattgtaattcttgaattcccatttctgctttcatttgaatgtttgccattcttccttttgccttagtcctacatatgtgaaccatttaggaatatgatttatgcaggaggaagagtgaagaggttccttctggacactgggcccttgaacttgaagatcctgcttttctgtctggaagacatggccctaatatgcagtggctcaccaaagcaggtattgatcttgttttcttgagaattcttcataggcatgagtcactagccagaccacacatcagctgtcatctgcccaacatttttgtcattttggaggagatgagtgcaaactgagaaagtctctctgcttgtttccctgggtggtacttatgctgtctgaatgttcctttctggaatttattagttagtgattttcttttcaataaacacttgtagcatacatactagtgtgctctcctaaagggggaaataatttggcagccttatcagcatgttattggactttcgttttgtttgtaatcttaagacacctttttcccactcagccattcagcaacattttcccttccccagccttggccccgccacctgaaacattcatgttcttcctctaagacagaataccaaccaagtgcaggcagccggttgacacaaccagatcaaaaggctttgaattctgaaaatgattcccctcttggtatcaagcccagtgataaaagcaaagcagttgtcatcttgaaaacagagctgtatacacagcagagcctttccaattagcacacttaagatgcgtgttagaaatgatgggaagtgggatgttacagagtgaaatgcaggtaatagggctttaaattttcatgtttcagttgatttttttctattgcagttttaagaaaatcgttgcacattattgaaactcctaagtgcatcttaccattgctcttctgtttacaataatatcttccaaaacaacagaaatgttggtcacaaaaaagcttgtacccattggttttccaagtagaggaagaataatctattattcaaaatttccctaccatggatgaacaaatcagtttaggtggcttttctgcctgctaccagccaactacttcaatggaatccctgaactgaacaacctggcatttttcatgttcactagactcaggcttagaaatggagcctcctcacaggatccacacaggcatatggagaaattaaagccaaatgtccagcaaaaaccaatgggtgtgttacataaagataccagagttatttaaatatgtaacttactcaccagtatgtaggctgctagaagtcaggggaaacctattaattttgaatctctggtgtctagcatggggcagcatagagtaataattacagttgtggtggatgtgattagtactcaccaatatttccagttcccctctccttttgtgtacatgggagaattatgctttcctttcctcttgaagtgagatgtgccttgctttggtcaaatcagtgggagcagaagtgatttgtgtcacttctaggtataagcatttaagacctagtaaatggcccttctgttatggtaaaccctaaagccttttattgagaaaggagcattataaaatgttggagactctgttagtttaggtcagtgaataactacagtcaccagagcccctttccaccagccaacccacactggacatgtagaatgagagagaattaaccttttgttagtttaagccactgagatttgggacttgttattgcagccaaaataatctaacatattttggctgatatactaatgaacatttattcagtgctgtgtgcttcaagtatttttatgtattaattcacttaatcatctctataatcctgtgaaaaagatactgctgttatcaccattttgcaggagaagtcacatgggtgatgagatgtttagtcacttgcccaagattgtatctctagtaaggagcagaactgaaatttgaacctaggcagtctggtaaataataaatggtgaatgagaaagtcaagatcagagagtgctttgtgatttgctgcagctatgatctttcatgtgacatcattggaggaggtaccggtcagtgtcatctatcccagatctctctgctacctgtcatttttccattatggtttcttacttttaggtcttgaaagttttcggctttctatctgcctatataattcacatagtgctatggtggacaacactctgtaatggtttttggaaagctaggtactccacaagagtgcatgaagcgtcagagaggaggtctagaactctgggagagctaaggagcaatcaaggactagagctgccctttggctgagggttccttcattaagactagtgactgccatgttgtgctgtgagcccagagaagacgagcatcctgtgggagttcccacctgtggagttcatccagcctttccaagcagtagtgggagataggatgactgtgggtatgctcaactgtttgttgcttccaaaagaagatgagggccaatttcccaaaagggtaaaaggaaagaagttgtggcatagtctgagaggctcaagaggtttgattttgctcctttgttctaatatggtttggtcaaggtggtttggtgaagctttagggaacttcttattgtaagtaacagaagcccattcaatgttgtttaagcaaaaagcaggatttgttaaaacaatgtaaaatatagggtcctcttatggatccccaatcctggatgtatagcgagtcctcatggaggactggaacaagaaattgggaagctctctggaggcacagctccctcttcaacttttggaggttatgcaaaacttctctcaattttctcagtacatttcagctcttctacctggttagtattctctgctgtcataggttcaagggcaaacatggccatgatatagtacctgagcttatggatcttcagttcaaataaccatgaaaaagtgattagaaactttaacttccaattcaacaaactgggaacagaaaatttgatccacgttgcatggtctactcctggcctcatcatcggtagtggtgggatcatatctgacatttgttcagcagcatatgttgattgcctaggatgtgacaatcactgggttatgtgctgaggatgtggaatatgaataaggcagtgcctctgtcttttagattctcctgctgcggaggggcatgtgaggccagaactcaacccaagggatccaattggacccatgcctaacagttagaaggagccacattttgttttaatataaggaggttttaatagctactattgtgagatggtgaactcaccgatgctgaaattatttcatctgagataggatgatcatctctgtaacaggatgttatctgaataattctctcctcttccagcagattagaccacatgacccttgttctttccaactctgtgattttaaaataaaccatgtgatacagtctgtagaaatgaagggggaaaatatgtgctagaagtggtcagaaaagtctctttagagtaatgaaaacttgaatttatccctgaagaaagagaaggcacatagacacaggagaaacaatatattcccagttggcatagtgaaatatgtaaagacacaaagacaatggatgtggtatgtataaaagagaagacacacatctactttgtgtctttaagaagctaaaggaaaataagcgtttgggagggtattggaatgatacaattaggaaagtggacctatagctatagtatcggagaaccagagggaacttgttttaggtagaatattatttgctgtaagagaacacccaagagaaagtgacttaagcagggaggatatttcattatctcacgtaagagtaagactgagttaaagaattaagggattgctccagcagatgacatcagggaccaagactctttccatcttttttctctgcccattttaccatcttggcttggtgcttacacttgtttcctcatagtcacagcctgagcatgatggttccatgaattgcaggtggacacaacaagatctggagaagtgagagggatgtgtctttctgtgcatccctttttatttgagatatcctttttcaaatgtcctccagaaaatgtctgtttgtgccccattggccatggttagtcacatacccacaccttagagttaggggagttagagaggaaggcaggctttgctagtaatgagggggtttgtggggtaagagttgtggggtcagccactagtggtattgctcccagccagctcttgcaggtcatcttgccccatcacttagtttcactgataaagataaatcataactgtcatatgtcaagtatctgttatacactgggaactctgcagtattttgtttttactcttggcagcaacttttccaggtagatcatgtcattctcacttactgatgaggagactgagtggtgtgtaggtgactcagatacttagtgcctagagagatgagatcttatttgaattttagaatcacagagtctcagttttgaaaaacgttttagcccagaactgccttcttctccagaggtgcccagccctaccttcaacatccctgcccagtggcaatggagccagcttttcaatatttgcagagacgaaagttttctgaccactggtccagtgttctttccaaaccggatcactggcagagcacagacctgtcatgggatagaggataactgctggttttcttctgtggttccacctccccacccctgggagggatcttttaagatactggctgctggcactagtgatgtcatggcaactgttattgcagggcacgttgaaatccattagcaggcattcaaggctcctcatgagtaaagtaggggcaatgtaaaaaagttagtttggcttccccaacttccttaatcccaagaccccgtgccaggtacttgtattttctatttgctaaatgttagttgaaacaaagggctgttttgttgggtttgtgtttccctgtggaaaagattactctaggcaaattttagaaaatgcttttaaaaagaatcttgtgtaagttgaaaacagagggaaagaaagtaaatgtcttgatggctttttattacaataaaaattgtagtgagagctctttcaattccctccctcctcccatctactaaacaaacctttgtctgtgggaggaggattatgtttaaacaagagagcaaggtgggaaagtggcattatttgagaagtcctagtgctgataagtttgtgatcagtgacttcttgagtacttgtcaagattaaagaggtgctttaaaagtaagaatttgctattggtggttgtgggaagggattacctatagatccaataggaaaccattttgagtctgtaatgtgaaatttggggagtagaggagggtaaaggaaacaaaattcaagcaatgaaaatatttctttttggtaggggaaatgcttctagagttcaattgctctcctcagatacctttaaaattgccttacctttttttgactatgataaaaggacctcttaggcatatgtgccaattatcagagattttccctgataatatgataaattttcatactccagtgaaatttggtgattggcaggtcattgggttggcagttgtggttctggtgatgtcctagatatgttggaacttgggataggtctctggaggacatgatgcaggtagccttctggtagtcaggaggaccccagctgtttctccacatggctcctaaaacaggcaagaaaatggtggatctagacctgtactgtcaaatatggtaactgctagtagccatatgtgactattgagcacttgaaaatatggcaaattgagatgtgccataagtgtaaaatacacaccaaagacgtagtagaaaaaaggatgtaaaatatctcatcagtaatcttttattttgacaagaggatgtaacaattctaaatatacatgcaccaaatactagagtgcccagaatcataaataatattagacctacaaaaagatgtagaaccaatacagtaataagggggacatcagtaatctactgacaacattagacagatcatcgaggcagaaaaacaacaaaccctggacttaaattggactttagaccaaatggacctaatggacatttacagacattctgccttacaaccacagaatctacattcttttcatctgctcatggtgcagtctcaaaaattgaccatatgctaggccacaaggcaagcctcaatacattttaaaaaattgaaataatgtcaagtaccgtctcagactagagtgaaatagaactagagatcaacaccaaaggaaccctcaaaactctacaaacatatggaaattaaataatctgatcatatgtgattgttgggtcaatgatgaaattaagtggaaaaaaacccaattttctgaaacacatgaaaatagagacataacataccaaaacctctgggatacagcaacggcagtgccaagaggcaagtttttaaaggattaaatgcctgcataaaaacatagaaagatctcaaattaacaacctaaccttatacctagaaaaacaagaacaaactagaaaaacaagaacaaaccacacccagagctagcagaagaaaagaaataacaaagatcagagcagaacaaaatgaaattaagaccaaaaaagccactcaaaggatcaatgtaatgaaaagttggttctttgaaaacataaataaaattaatagaccactaactaaattagcaaagaaaaaagaagagtcacataaacacaatcagaaaagttaaaggtgtcattacaaatggtataaccaaaatacaaaagatcaccagagactattgtgaccatctgtttatgtacaaactagaaaatctaaaggaaataaattactgaaaacatacaacctcccaaggttgaaccaggaagaaatagaaatcctgaacagaccaataatgagtagtgaaattaaataagtaataaaaaaccctctaacaacatcaaaaaaattccaggaccagatgggttcatagccgaattttaccagacatacaaggaagaactaataccaatctttactaaaactgttccaaaaattgaggaggagggaatccttccttactcattctatgaagccagcatcaccctgatactaaagccaggcaagcatacaacaaaaagagaaaactacagatcaatatcccagaagaacacagatgcaaaaatcctcaacagaacactagcaaactgaatccaatagcacataaaaaagatagtatactgtgatcaggtgggttttattccagggatgcaagattggttcaacacacacaaatcaatcattgtgattcactgcatgaacagaattgaaaacaaaaatcatatgatcatatcaatagatgcagaaaaagcattagataacatccagcatctcttcatgataaaacccttactggctgggcgtggtggctcacgcctgtaatcccagcactttgggaggctgagatgggtggatcacgaggtcaggagattgagaccatcctggctaacatggtgaaaccctatctgtactaaaaatacaaaaaattagctggacgtggtggtgggtgcctgtagtcccagctactcaggaggctgaggcaggagaatggtgggaacctgggaggcggagcttgcagtgagccgagatcacgccactgcactccagcctgggcgacagagagagactccatctcaaaaaacaaacaaacaaacaaacaaacaaaaaaaacccttaccaaactaggtatagaagggacatacctcaaaataataaaaaccatgtatgacaaacccagagccaacatgatactgaatggggaaaagttgaaagcattccttctaagaactggaacaagacaaggatgcccactgtcaccactctgattcaactggaagtcctagctacagcactcagtcaagagaaagaaataaaagtcatcttaattgggaaagtggaagtcaaattatctctgttcactgatgatataatattatacctagaaaaccataaaccctcctagaaaagactcctagacttcagtaaagttccaggatgcaaaatcaatgtacaaaaaccagtagcatttctgtacactggtaatgattaagctgagaagcaaatcaaagactgaatcccatttacagtggctaccaaaaaaacactgaagaatgcatctaatcaaggaggtgaaatatctccacaaagagaagtacaaaacactgaagaaagaaatcatagatgacacaaacaaatagaaaaacatcttgtgctcctggaatggaagaatcaatataattaaaattaccatactgcccaaagcaatctatagattcaacccaattcctgtcgaactaccaatgtcactattcgcagaatttaaaaaaaaacttaaaattaatatggaaccaaaaaaagcctgaatagccaaagcaactctaagcaaaaatataacaaagctagtggtaccatattttttacttcaaattatactacaaggctatagtaaccaaaacagcatggtactggtataaaaattatacttggaaaaatagaactgaatagagaacccagaaatattacttacctataaacaactgatctttgacaaagttgaaaaaaatatactctgggggaaaggacaccttattcagtataattttttttttcagagacagggtcttactctttcacccaaagctggagtgcactggtgagagctcaatgtagcctcaaattcctgggctcaaacagttctccagcctcagactcccaagtagttgaaactacaggcatgcaccaccatcctggctgataccctatccaataaataatgctggcataattggagagccatatgcagaagaatgaaactggacttctatctcttaccatatataaaaatgagctcaagatggattaaagacctcaaactacaaaaatcctaaaacctaggagaaactgttctggacattgatctaggcaaagaatttatggctaagttctccaaaggaaatacaacaaaagcaaaagtagacaaataagacttaattaaaccaaaaagcttatgcacagcaaaagaaacaatcaacacagtaaaaggacaacctacagaatgggagaaaatatttgcagacaatgcatctgacaaaaggctaatatccaccatctacaaggaactcaacaaaacaaacaaaccaaataacccattaaaaagtgggcaaaggacacgaacagacatttttcaatagaagacatacaagcagctaacaaacatgaaaaactgttccctatcactaatcatcagagaaatgcaaattaaaaacacaatgagataccatcttccaacagtcagaatggccattattaaaaagtcaaaaaacaacagatggtagtgaggatatgcagtaatatgcagtaaagggaattcccactcatacaccgttggtgggaatgtaaataagtataacctctatggaaaacagtatggacatttctcaaagaattaaaaatagaactaccctttgatcttgcaatcccactactgggtatctacccgaaagctatacaatcaacctaagtatccatcaatggatgattggattaaaatgtagtgtgtgtgtgtgtgtgtgtgtgtgtgtgtgtgtgtgtgtgtgtacacagacacatatatacctacttacatacacacacacacacatacacacacacaccatggaatgctactcagccataaaaaggaatgaaatcatgtcttttgtggcagcatggtttgaactggaggccatccattatccttagtgaaatgactcagaaacagaaaatcaaaaaccacatggtctcacttataagtgagagctaagcaatgggtacacatcgacatacagagtgggataatagacactggagacttcatatggtaggaggatttcgggagaaggatgaaataccacctctagggtacagtgtgcactatttgggtgatgggtgaactaaaaaacccagatttcaccactgtgtgatatatccatgtaacacaactgcatttgtgtccccaaatctataaagaagttaatttcaaaaaatattttgattacatgttgattgtatttgggacatattaaatgaagtatattatcaaaatatttttttctacctgtttctttttgcctttttaatgtagctactagaaacatttaaattatctttgttggctcatatttctattgggcaatgctggtctagatcaggattcagcaaagtatagcttactgtctatttttgtaattaaagttgcccacttgtttatgtattgcacatgctgtgactgctttcatgctatagtggcagagttgactagttgcaacagagactatatagctcgcaaaacctagaatatttatcatctggacttttacaaaagaaggttgctgaactctgatctaaataattctagaagacttggcaggacctaaaatcaatctaggaaaccctgattcttactcttgtaggtcacactcttaggtaaggaagagagaaccaaggattctcctgacactttagaggtgcttctggcttttgctccctcttattcctaaactactttatctaaacaagctgtaaactttcactcccctcctgctaagagcctggaaggagggactggagagccagcatattggctctgcatagaaggcagatttggagcattttaccacccagtggaagactatgaaaactttgctactgattcatgcatttctaaaggttttccagtggagacacagagtaagggctgaaaggtagggacaaacatatggactgacttaagaggtccagtgaccccaatgagcagccatagtacatttaaattatttggggtggtaaagatattttagacccaagaggtttcatcatcaagaacctttttcaaggaggtgtgtagacctaacaccttcattatcagctgacgccataagctttggggaatggagaagactggaaaggagatgtggaacacaggatagaaggcacaagaggctggagcttatcttgactagaccacagcccacacccgagaccgccctatgggcatgggccactggagggtaatcagagactttggtgtgacgcctccttaaaaatctcttcccactttcttctcccaaaataaatacattttctaagacaagaccctgaatcagaatcagtttttctacaaactttgggtggtgttaattcctgccaacacagggcaaagcatattacagtgaatggagttacagtattcagaatgaattatagggcgctaggcacgtgatttaccacctatagtaaacagggcttcacacatggtgtatttctgctgtgttggttagttattaactgcaaaaaaggggaaattcatttagaagacgtgctcattttttatgaggtaaggctgcctggagatgcatggcattttaaagcaaacgaattcctgggagagcccgagcttaccacccagaaatgtggcaaggaataaaaacatttacaccagtttaatatgaatggttgaagaaaatatctattgcacattgaacatgatatatgaaaccataacctactcttgtgtagtaagctacagaaccattcacctaacagattactattcgagttgacattattctgcatcttttcgatcttctcttgccaagtgctggaaactgtcagagaaagccagccagatacataggcactgttggcctgggggttgagaactcataagactcttgaaggcggaggttacccagtgacccccttgctgcaaactatagtggaagtcaaaggatgacagccaacataaacagcggctgcatgtggaacgtcaaagtcaagacaaatagaggtgggactttctctgtctcctgctccctttctagtctgtaaaatggagcttatttcctatcatctagcagaataaaaagtgccatatggctttggggggcctcagaagtgcttcttggttcattcttataacataggtggaatttgacctcctcaaaaattattaaggggtgactcttgcttaatcctactgtgatttattggctacatactggatatcaaagccaaaaggaatcgtaggagacgttttggtataactctttcttctcccagagatgaagaagctggagtctcaaaaaggttaatgaattgccaaatgtcaaatgctagttaagtgcaggactggtgctaagaatgcaagtatatctcaatttctggcccggagctcttgccttctacctttctgcttgtgtgtgcacacacaaagttgcttgcaactgctgttttctttttgggtagagtaatgaaaaatgacttttgatgtttttgtaaatttgcaaatggtctaggtcagtgtccatgttaagacaccttactcggcctgacactcctaattggttttaagattctgggcctgtggagctctttcttttaaactattaactacgaagttttatatttcaactcattcacatctactgaagtgatagcagcagttttatatgtgggcagattaatgcactttgggaattttagagaattaactttactgcccagtgcatttgtggcatatttaagtaaactagagaggccgatccttgcaaaagcaaaagatattctttttaatgtgaaatatatgggttttgacatgactataatttttagactctcaagaattttattctgatgttttgtctgacatctctaagctctttaatatcaccaaagaactcttggtttgtattaattctgtttcatttgtgtattttatgtgtttagtggtcatatttgaaaaacatctcttgtgagcgctctgtataattttggcagaaaattactttttttgtgtttctgtgatgatcccctgagatcatttttgcataaatccggccttctattttcagatacaaatctgttgtacagatgattcttcttagaagaaaagatgcatttgtagctaaaaaatgtaaattacttttcatggaaaatacctctctgggcccccatttccaaaatgtgatgattgcacatcgcatgtttttgtgcgtgctcaggggactgcttttcttataattagaaaagtcttgattgtgcagcaggtagaatggggtggcacggctgcttctgcagcataggtgagtcagtggaggtaccagaggaataagcaagagaccttatgtggaggtggcacttcactaagggaaggaggtcttagttgttgaagtgggtgtgtcatgagccttctttacaggatgggaatgttaacagaggacttttagacctggagacatttaaacacaattgccatcctctgtttgtattttcttcttgcttgtgattttttatacaggattcaaagttttatttggtctcttatggaagcatgtttggaatgaacaccctcctcatcacaagttttatgaaatagtggaggacaacagaaacctcttcctaaaatgtcttctgctcagtacaagggttagtgtttgagggactttgaggcactgctgtaaagcaaagtgcaaaaatcaacatattcagatttgtgccaaagaaagacttgagtttgagaacatttacatctgttttcaataattcctcgcatatgttgcagaatgtacgttatccatcttgttatccaggaaataacatttgttgcaaacagtttgccaattcgtaattttattgaatttgtttatcatgctgtggcttcatatgaggtctgaaagatggtgatctttggtgttccagctgttgtaacattctgcagtggggccttaattccaggatgagctggaattctttggagggtctgggctttctgagaactacagcataagagccggcattgctgatgggcaattatctttggggaacgcagtaactttgcttgtacattcctcaaccccattttcatttctggcttttaaatgtagtcttgggactgatgtgttgaatagcactccttgtgtgccctatactgtctcctttgaaacctgcccaaacttttaaactgtttttatgtttggtttgagaggatactgctccccaggaaaaaaatgattatttagaacgaccccaaactatctcagacctgaaaagaagtagattctcttcaacagagaagctaagaaatatctttttgctgcataaatattatcattttcttaaggagttgttggtaggtgaaaagaaagttcaaccaggtccaattttataattttcctattttatttagcaggcattttctttactgaggtttatattgtctgccaaaactaggaggaaaagaaaatattaacaaccctgaaagctctttcattctgaattattccttaatgtttttaatgatttattataaccacacaaatgtgatcttggggccatttggaagttattgagtttccttggagatgggacttggcattttccaaaccagagtttgcttttgtggcctggaagttgcaaggcatatatatttggaagactaaagattattccccaccaagaagttttgtcaacctgaccttctctactcttatgacgctgcacacacagcagtaatctctgcagaggagagcaaataaagtgaagaaatatagcggtacgtgttatttttacatcctaaagtaaattctccagcattaaggctgactgggaatttccatctcagagttctcatgaatgctgctccactttggtgttgtcctcttgaatctctttttattataggtctttgaaggaggtatttcttgtaatttattcagccagagagataagtgagatgtggaattggggaaacaagggggtgggaaaagccttctggggtcagctgtccctgccgttgagcctgcaggctttttttaggtgctgcagccagtcaaggtgaaggactagttcagctctatttagaaaacaagtgttatctaggttctgtgttatgagatgacttttagcacaagattcaaaagttagtcttggcaaaatggacattctttgaatgttgttggagctgaatggctctagatggtgtgctgagcccttcccatgagatgatgttccagaagaatcccagagatatgaggccatcctcttcagctccacaccaaagcaggcatccactcaaggccagctcaacacttcagctccacaccaaagcaggcatccacccaaggccagcccaacagttgaacccttccactagtaaggagcaaagcagcctggatcatggctgcacagttctcgggagaacagttgtctttgttttaatgggctgtctgtggccctgcagcttctctctactggccccaattctgagaatgcagttttaaaaatcactttttggaaagaaaaaaggaaaaattctaggatgttaaaaaataatgtttttctgatttatttttacctaaatctggtgttctgagtcaactttcaaggtcaattctgttattttaaggaataaaatatatttatttattcctgttttttcccttagaatatgttagtaacacttctaaagcattcatgaaatatcttaggtttgaaggaagattcagatatgttaattaagtctatctatacttcccctggcttgtatattctttagggtaagggatactgtcttatggcaaattttgactggtaccatgttcagcacttggcctacaaaacaaatgtttgttgttgagtggatgttgaatgcatacatttttgaataggccacttttttttttttttttttttttttgctgctgagagatgtcagttgactgcttgtatcccaacttcatcgtgaaaagatgtttttctgctattcactttaaaagcatctgttcatcccaagtgtgcagtgaaagggcttccctccttccacctcctctcatcatagattttctttgattagttatcactggatcaaattattttgcagtatgatggagtgggaagcatttttgagacctaggtcagccacttacctgcttatgagcattacttgggaaaatatatcgaaccaccttaaacgtccatttccccatctaccctcccttgaggggctgttgtgagcaaaatggcctgtgtgaagctctagtaacccagcagatgctcaggaggtagagatggtcatttcgcattattctgctggacttgaccctacatctcctgctgatctttgtgtatgccaggggtttgggccctgtctccaagtgcctgcattttagtgaacttggattctgagattccatgtacattagtacactgtattagtctgttttcatgctgctgataaagacatacctgagactgggcaatgtacaaaagaaataggtttaattggacttacagttccatgttgctggggaagcctcacaattatggtggaaagcaaggaagagcaagtcatatcttatgtggatggcagcaggcaaagagagggcttgtgcagagaaacttctgtctttaaaaccatcagatcttgtgaggcccattcactatcatgagaacaatatgggaaagacctgccccatgattcagtcatcttccaccaggtccctcccacaacacatgggaattatgggagctacaagagatttgggtggggacacagagtcaaactatatcattctgcccctgggccatcccaaatctcatatcttcacatttcaaagccaaccatgccttcccaacagtcccccaaagtcttaactcattttagcattaactcaaaagtccacaatccaaagtctcatctgagacaaggcaagtcccttccacctatgagcctgtaaaatcaaaagcaagttagttacttcctagacaaaacaggagtacaggaattgggtaaatacagccattctaaatgggagaaattagccaaaagaaaggggctattggccccatgcaaatccaaaatccagcagggaagtcaaatcttttttttttttttgagacagagtttcactcttgtcgcctaggctggagtgcagtggcgtgatctcggctcactgcaagctccgcctcctgggttcacgccattcttctgcctcagcctcctgagtaactaggactacaggcacctgccatcacgccaggctaatttttttcatatttttagtagagacgaggttttactgcgctaaccaggatggtcttgatctcctgacctcatgatccacccatcttggtctcccaaagtgctgggattacaagcgtgagccaccaggcctggccagggcagtcaaatcttaaagctccaaaatgatctcttttgactccatgtctcacatctaggtcacactgacacaagacatgggttcccatggtcttgggcagctctgcccctctggctttgcagggtatagcgccgctcctggctgctttcatgggatggcatcgagtgtctgcagcttttccaggtgcatggtacaaactgttggtggatctaccattctggggtctggaggctaatggctctcttctcatagttccactaggtagtgcctcagtagggactctgtgtggaggctccaatcccacatttcctggccacattgccctagtagaggttctccatgagctccccacccctgcagcaaacttttgcctgggcatccaggcatttccataaatcttctgaaatctaggtggaggttcccaaacctcatttcttgacttgtgtgcccctgcaggctcaataccacatggaagctgccaaagcttggggcttccaccctctgaagcaatagcctgagctgtaccttgaccacttttagtcatgactgaagtggctgggatgcagggcaccaagtccctagactgcacatggcatggggaccctgggcccagcccgtgaaaccattttctcctaggcctctgggtctgtgatggaaggggctgccatgaagacctctgacatgccctggagacattgtccccattatcttggctattaacatttggttccatcttacatttctgtagctggcttgaatttctactcagaaaattggattttcttttttactgcatcatcaggctacaaattttcgaaattttaatgctctgtttcccttttaaaactgaatgcctttaacagcacccaagtcacctcttgaaggctttgctgctgagaaatttcttccaccagataccctaaataatctctctcaagttcaaatttccacaaatctctagggaaggagcaaaatgccaccagtctctttactaaaacataatgaaaatcacccttgctccagttctcaacaagttcctcatcttcatctgagaccacctcagcctggattgcattgtccatatcattatcagcattttggtcaaagtcattcaacaagtctctagggatttccaaactttcccatattttcctgtcttcttctgagccctccagactgttccaacctctgcctgttacccagttccaaagtcgcttccacattttcaggtatcttttcagtggcaccccattcttggtaccaatttactgtattaatctgtcttcacactgctgataaagacatacctgagactgggcaacgtacaaaagaaagaggtttaattagacttacagttccatgtggctggggaagcctcacaatcatggcagaaggcaaggaggagcaagtcacatcttacgtggatggtagcaggcaaagagaaggcttgtgcagagaaacttctgtttttaaaaccatcagatctcgtgagacccattcactatcacgagaacaacacgagaaagacctgcccccatgattcagttgtctcccactgggcccctcccacaacacttgggaagtatgggagctacatgagatttgggtaggacacagagtcaaaccatttcatatactctccctagtttcctggctaaataaggtgatcacatatcataggttttctgtggctatctcattttaaagtatgttgtccttttgtcctctaaattattgaaatgtcaagaaaatctcaacaacttgatgtctagttttagaatctcccagccagccccttgcaccagaaaatagcacaaacgacattgtttaatgcatcctaattttaatcagaaaacagttatcctatttctggcatatcatggatcacctgactggtacaagagaaagaagggttttgtagggatattgcaaccacgtattaaagcctgaaagacactctgaagagcatctcatattctaatgtctctgcctattagggtggtgtatcaagaagatgtatcttgttcattggtactttcaagggctgtgatctctccataagtaagattatcagtgattggagccttttcctcctttgatgatctcttctctttttgcttagtttcccattgctgctgtaacaatttgcaacaaacttagtgggcaaaaataacacagctgtattctccttctgtccctccaaaattcacatcaatcctacgtgaagtatacattcaccccatcccaaggtcaccaaaagtttcagccattacagcttcaagtctaaaacctcatctacatctcatcagctaaaaataacaaatctcatgatctcaataatttaaatcaagtatgagtgagccgctaagtataatccattcttggtgaaaattactcttcatctgtggacctgtaaaatcagaagtaagttgtctgcccccaaaatacagtgatgggacaggcacaggagactgtttatagacattccattttaaaagggatacagtgaaagggaaaaggagtcagtcaccagtcccaagcaattttatacgtggcagggcaaacttctttaggtttcaggacccgggaataattctgtgtggcttgaggacctgcgctctggatttgagcttctacactctgggcttgaggctccacccactgggtcatccttcctttttcgtgaaggtaggatgtgtttgcagctgagtagttttatcagcctgtttcttgtctgtagaacttgcctactttacagccttctttcattttatcctttttatcccttctattctaagctgacagtatttctgctagtataacattctcaaaaaacttatggtatccaatgtatgtcatggggattcattccatgagacaaaagggtcctccatagctttttctggataattctatgtctatttctggcttctgttgagatggttgaggggattcacgagtcacatgcctaatctcttcaaagagctttctgtgtgaaagaatactctgatattttgacccttctgagttatttgccaaaggttgttcatttacaccctggctttctttctagagtatcccttcatggcagtgaacctcctaattttaaccttctttgcaatctgaatagctgagcatttcccaaatcatcaagtcctggctcctttttaattaacatcccttccctccacttatcttttccttcttgcctttcactataagcagcaagaggaaaccagattggaccttcaacactttgcttggaaatttcagaaaaatatccaactttattgctttcaagttgtgctttccatgtaactgtaggacacaattcagcaaataatgctgccattaaaaactaaggatcctcttccagtgtccagtgatatgttccttatttccttccgagctctcagcagcagtggctttaacatccatactgccactaatagtctgttgatgatgatttgggtattctctaagacagtgttggtttctctgcgacagtcctcgcttccttctgagtcttcaccagcggagtcattcatgccaatgtttctactaacagcctgttcaagcccatgtaagcttcttctatcatgctcctcaaaattcttccaacttctacttattatcaaattccgaaaccacttctactgttttagatatttgttacagcagcactctatttataagtgtaaaatctgtattcgttttctattgtcattgcaacaaatttccacaaacttagtagcctacaagtaatacacatttgttctcttatagttctagaggtcagaagttcaaaatgaggcatacagggctaaaattaaggtgatgggaaggctgtttcttttgggagcctctgagagaaaaatctgtttcctgtgcattccagtgtctagcaaccacctgtattccttgtcttgtggccccttcctccttgttcaaagcacatctctcagtttactgttttcattactatatcactgttttctccgactctgactcctcctgcatccttcttataagtactattgtgatgacattgggtccacccagataatctagggtaatcctttcatctccagaattttaactcaatcacatttgcaaagtccctttttccatatgaattcacaggttctgaaaattcatggacatatttggggtggtgttatgtagcctaccatatcgctattatttcagttctcccaacttttagaaggttgatagacagcacgtagtagtggaaggaactaatctgggagtcagaaacctagatttcagtcccacttgggctactaaaaggttttatgccttagatcaagccattttgcttttttggacctcaatatcatcagttgtaaagtgaggggattaaactgagtgatggctaaggcccttcaggactctctactgttatgcttctttggttctgggctttcattgcaatgaggtgcttctttagaaataagaaatggtgagttttagttgctgaacagtttagagtgaattagccaaaatggtgctgcagttcagtgctaaagtcagttgaggtgacttagtttactgttgttgttcttgccagattatgggccttttacatacagtagatgctcatcaaactcaatggaaaagcattatcaagcacagtttctcttagaaggcacttgcactgaataagaaaaaaaatcctcactctcttagtgtaggggttcagggcgacttaaatggtaaaatctgaggtctgagtaaagggtttcttatgttctctagggtggaagttatggctgaggaaggatgggaaggttttccgaaggtccgtgtctccagtaggagaaagcaggtcctttggagaaaatgtgcattggcttttgctagattcttgcagctgcacagaaggctgctgcagccaacacatgttatagagctcaagagagttggaagtgatgtctgatgctaagtcctccacaagcaaaccagggaaatcaactgaagaagaggcctcaaagaaatcaggtcaaggaatttaagcactgagtctaggaggattcagaagaggatatttagtttttcagcttgtcctctgggactctataccactggggactcatatacaatatttctgttgttgctaaagggcagtaagtatgatgattagaatttgaaaagcagtccctctggtaggccttaggattttctaaactgctttgcaaggctaggttaaatcttgtgtttttttaaaagaggaatcttctattcagcacacaaatgagcaccctacctttgagcctttgtaattttactcatgttatttcctatgtctggaaattcttgtccacatctttacctgcttacaatcttctctgtccttcaaggatctgcttaaataccatgctttcaaacaaaacctcttatttcctctctctccgaatgatcttttctttttcttaaactcctgttgaattttcagtctttaattttttaacagcattggccacagtaggaatttaaatgcatgctttctctcaggtgcattataatgtcattgagacatttattcatctttgcatctctcatagtacataaaactggagaggagggcttaatatgtgtagaaagaatgaatagaaaaaatatctaactgtacatgtaagcatagactcactgggtacataaaatataaattaatgtccatagaaatctatattgatatactgatattgatatagatatagatattgatatagatagagatgacttagtactcaagatagtgctgagtgttgatgtaagagatgtataaggcttgaaactctaagccttagtaaaaccatattctaattgtggagagaatatagcaaaatattcatgagcgatagtattaggtggggttaaattttgtgatacagatagtcactactcctgtatttcagagaagaggatgctctctgtaagctggagtggttggggagatctttgaggaggagaaagaatttgagtgagcccttgaatgatcaaacactttttcaggttttaaggtcttcgtagaaatgtcaaacattttcatgtttgtctataggacaattgtcatatctttcattttagttgttaaaaaatagaatggacaaaaaatggtgccagttcaaaatgaatttacatgtatttgtaatgcatgttttaaattttgtcttcaaccaagcttaggacacatgtggatttgaaggctcaagaattccaagtaaccaaaagagtataattgtattgtttataacagaaagaaaagataaatgcttgaagtgatggataccccgtctaccctgatgtgattgttatgcattgtatgtctgtatcaaaatatcttgtgtaccccatagatatttactatctactatttacacattaaaataaaaaaaaaaattccaaggctccttggtgtggaccatggttctcggaatctgtggagtaggaccttagtaaatacttgtgtgatggtgatggatttctggttaagatttcttgatttttactcttttaccaatttcttaactatgtcgctaaggtttagttagctttttttgttgttgggtagacatgtcctaaaggctttttgtacccgatctcagaagcttgtttttcaactgaattgaaatgtattttcaattcagtaaatgaagtatatataaaaaccacaatgactaaaggggcattttaaagaaggttaggggcaggaaaatcaactaaatttgatgactgaaatgttctatttttcaaatgtccataacattatcaggaggggaaaagccagaaaccattgtgattaaaactggtgatatatgagcgtggctttatcgaatatataatatgattatttcatttgtaaagtgctttgcaatgcatgctgagtcaaatgcaatacaaatactaatataatatccagcattgcaaatccagagaaaaatgtattgtgtatcgtcttatgaaatataatttccagtgattctgaatagtttatatagggaacattttttttcttgcttttcatgcttctaattaaatgaccagaataaaacaatcacttgaaaataaattctgaaagattatttcttaacatattttcatatttttgccagcttcgaactcttggattctagctggcatgccagctgatttgtgtgggtcatccagactgtgagttcaggtttttttcagggatgaaaaagtcaagcctcttgctttggctgaagtgtctgagtttatgataatgtaaatattgccttgtttgtcaaaaccaagcctgcatcttggctttcttcaggagacctggaaagagctactacttcttaactcaacaagcatttatttgtttcctacattgtgatcacatatgttttaagcattcttggtaacacaaagagtatttcctggtttcttgccaacttattggtttaaagtcctgcccagtgaagagtgaagatgtgtatttaaatactgcattgtgtgacagaaattccaagagtggtagatgatcaggaaaggagagacaatccatggattctagtaggtgggagagcacaacttgatatggccagtggcaatccaaccccaaagactgtgggcaagctggtggatggagaaatacaatggatggtgctctgaaggatttgggggagtcaaagggaaggggaaaaaatcctccaggcctatccttcacttagctttttatttttaacaaatgaaaaatacatagagcagttgtcatttgttaaagtgtagcagaaagagcgaaacaggccagtggaggcttcatcaagaatgctcattcagaatgatgaatgtggctaaacacacatttgttcgtaaaacttgcagagtggctgagcatcattaagcatgagaaataggtgcagcatgctgagaagagagtggagcaaacagatgttgtgaattttcacaggcatccttcatccaccagtccatcattaatatagttgaaggtgatcctttctttttatttaataagcacaaacaaagtgcatgtgttgtgattctgctgaatgcacttctttttctgaagaagtaagggcgtgcaagaatggggaggatatgtagacacatcagttccctgtgctcccataacatgatatcagccttggggcacagctagtgcagaataccacttttatttttccttttttttttttttcactcatcttgcagtagctctaactgcctcatcactctgtttgctacctagcagattatctggatctgcaggagaatgaaaagctttatggcttttgaccttgctaccttccaattctactccttaggatgcatccgactttcttttttttttttttttttttttttttgagacagagtcttgctctgttgcccaggctggagtgcagtggcacgatctgggctcactgcaagctcttcctcccaggttcgcgccattcttctgcctcagcctcccgagtagctgggactacaggcgcccgccaccgcgcccggctaagtttttgtatttttagtagagacggggtttcaccgtattatccaggatgatcttgatctcctgacctcgtgatccacctgccttggcctcccaaagtgctgggattacaggcgtaagccaccacgcctggccgcattcaacttttataatgacatgctacaacttgtttgctgacatcagctgggtagacactttttttccctattggcagaacttcattgaccctaccctgtatcatccaattctacttctttcccttccttctcttcgtttttacttcttggccctttgctagcatagatcttggcctacatacccttacaggccttccttcacttggaagcacagtccaggcttctcatcttgatccttggacccttgactaccaccaaaggattgagaaccctctcttttttaacctcatttcccagtttgtgaaatgaagatggtaatgcttcctttccagggttggtctaagtaaaagcattttgtgaactctgaaaagcatcctacaattattatgaatgttgaattgtgatctattaaacaatgagttctcttttgtagagttttcacttagggagttgtcaacatctgcttaaatcctcatggtctgtttgcctagagcttcacatttagtgccagatatgttgggtctgtgaagctgtatctgttttcactgtgtgtgtctgtgtgtgtgtgcacacgagtgagcacgcacgtgtgttgtatgtatctgttcattttcagaccaaactggaggggaaaaaacctacaagaaggcagtgaaactctcatatagagcttgagacaagatattgctttatcttgctattaatgaactatgaagaataacttataattttacagttgcgcctttcttcattcaaaataagcattattgggatcctgaataccctaaggcagaagtgaggaactccgtaataagtcatttcaaaatgcaaactatctactggtaatcataaatttgtttaacttgttacatgtactttttgaccatggcagctgtctgcctatgctttgaattggcatgttgagtttaagtgtgtttgtgtgtgcttttgtttaaagaccaatatctctactgtcatagagacccatctgagttaaaattgccaacattgccagggctttgtgacagtgctcatacatgctgtagctctggggttcatcttcagcagaattcatagaccagagtgccaggcattcactttgaagcaaagagaagtgttattttagctaacattgagcccacattctaaaggcaacatgcttggttcccgaagccttagcaagaggacaagataacatatttacatgttggatgtgttttaatcatctccttccatgggccttctcactctcaagtgcagcacatgtgtccttaaaggccttgagtagctgtggatctcctatggtttattatcgaacttaaatatacctgcagttaggaatgctatgttttgtctgtgtgaatgattgccctcaggaagagcatatgcatgtcgactcaagccagtcctgggagcctgagtcctaccttgtggctgccacccaaaccttgagagccctgctgttccctctggttgcttgggcacttggccaaatgcacaggaaagtggagtatatatgtggagactttgaatggtgtggtttgtcttcccacttgatactagttatgccgtgaagacttacctgtgaatgaggtctggtggtaacttatgttcaagcctggtgatgacagttcagctgctttgagatccaagcaccctgtaggtgatcagtgttatgccaagaggaaaggagggttggctttggcactttttggtaacctgcacgttctaaaagaaaatttctttattggaatgcatagtcatctctgctggtgcctctggagtagtgagtgagtgcttgctccagaactgatcttggtctccatgctgtgatcatcctagttaggacattgtcacagcttagatggctgtagtacaactagccctgggtttggaggcttggagtctcgtttcccctctgtctctgtttcttcattggtagatggagatgatggggctgaactcatcgcttgtttaaagttcctcagttatttagatatccacgtttttctgggtctttctccatgccaggcattgaaatgaaaaccattgaaattttaacattatcaatgaaaactgggtttactctaagtcggggttggcaaactatggtctgctgcctcttttcatatgcctgcaaggcaaaaatggtttttacattttaaatcatggagaaaaatcagaagaatactttgtgacaagtgaaactgatatgaagttcaaatatgagtgtccataaataaattctgtgcttctcattagtaagctgtgttataagaaattatgctcaatatttattatatttttaattttgtcagtaaaatttatttggcaaaggaatttttttctcttgttagtttctccatagtacccttgattttaccacttggcctagaaagcctgaaatatttactctctggtcctttacagaaagtgtttgctgacctctggtctatgttatttcacagtctcactagatgagtggtttgcaaactgtgggtcatgatccattagtttttggtgaaatcaatttagagggttacaaacagcatcttataaataaatgaaataaaagagaattttaaaagacaggacatatcaaagtgcattgcatgtggtatggcgaatgctgttttatgaagtttttctttcagatgggagcgtgtttgtatgtgtgtacatgctgggtcaccatgtcaaatataacgtgggtcatggcccaaagaggtggaaaagggtggggcatggtgtctgacacctataatgccagcactttgggaggccaggatgggaggatggcttgagcccaggagctggagtccagtaacacagtgagacccctgtttcttaaaaaaaaaaaaaattacctggggtggtagcatgagcttgtagtcccagctactgggaaggctgaagagggaggattgcttgaggcctggaggtcaaggctgcaatgagccatgatggcaccactaccctctaccctgggtaacagagcaagaccttatctctaaaatacgtaagtaaataagtaaatgaagaggtggaaagccacagcactagagcacaagctctttgagggcagaaagcctgtctcattcatttttgtttccttgggcctggcacaatgcctgggaaaaaaataggcttttaagaatgtttgaagagatgaattaatgagttcagggaagaaataaggcatgactattgaacattatggacacagctactaaataatctctgaacatgtcttaatgtgtttagctcaatgcatacggtttcctgaaatgaggaaatgcatttcagagagtgaacaaataatttattttctgtattggaagatggcacctaggaagctgggtttgagttccatcctgaaggatagtcaggtcatgtgttaagtgtggtatagagaagggggacaagcattggcttaggggtcctgagtgccagtgcttgctctaccctgaacttctgggaacttagatgagtttcctgtgtctttcttgccaaattccttcagcccaggcaaagtgagaatgataataatgattatcagacactcagctgtgaagatcagaggagaggatgaggtggagagcactttgaaaagtataaatccgtgtgcaaaggcagtgctcattattatgtcatgttaaaacgtttgtatcagaccctttctgtgggcaagacatgtgcttggcacagtgggaactagaaactcagaccccttaaggtcctcgtggttaaactaatgaatctttaaggttgttatactggtgaaaaggtaaatagcaacacaaaatttaaaataagccaatagaagaggagatgttgtaaggtcatccatgcccttgcaaatgttcagactccccaggctgaggcaaaagctctggggaaaggtgagaaggggaggtggtgccagaggtatgagatagagagtcttgaatagaaaggaaggcccttctcgctgggctgtggtagtggcagcagaaaggagaagcccctgtagatgaaaaagtcccctctcagtgagtgactccctgggctaattgctgcattactctctttgatgggcctgatggtgctgagataacaaaatgaaaaatcaaatgagaaatggaacccaggagtctaaaaagttagtaaattttgacattagaaatataatcaaatttcaccagtgcttttctgtagtgacagccaaatccatccatgtcagagcaatggcctatggtatgtggtttcgtgtggcttttcttccccctttctcttttccttttgcaaaatcagcattaggctatttggaggacaggcgagaactattatgttaaattgtgctacctacaacttaagcttctgtctttgctaaagctgccagtttttataaacaacagaagacagaaagggtttactaagaataatgttgaagcccaaaagaatcctacagcctataaatcttaatagaggttctgagattccagcaggctggatgtgtctcttttacccgggctcactccatcttggctcccccgtgatgactccaattttctcgaaacacaggcacagtgccttgaatttacttgtggcactttttgcctacaaacaggaatacatgcatataacctatgcaaatcaataaaaacatgtcaagaccccttaggtcgcactactctcctaaaatgcaatttatcttgctgcaaatgagagtaagggactaggtaacaaatagcgtctgatcatttaactagcacctgttgtcaatgcatttgaaaacggcatttttcatttgacatacagtaaattgcattttcatatatatcgaatagaaaagtgagctgggatgtacatatgaagccctttatgaattttatgaacaatggatattttagagctgtatgtttaaaggggtcacgtcagttgctgcaaatttatttgttccttccagcattggttgtgaacataccatagttttcttatggctggatgttgaagtgtggcaacgctgaaagtataattatatcattcatgttaggtgaaggacaattactataatttttgtataaaattgaatataacttaaatgtgtaaatatgatttttttttgtttttttttacaaaagtttcttgggggaaagctgctttttatacattacatttttcagtcaattcctttgtcggcttaaattatgagccacaggttttttttttaaatgcaatattttgtttgcagacgggtggctgttgcacaaattcaacaacacttaggcttatcagcaacaatggttttcacattagtgagcatggtttggcaatattatttgacatctggaacaagctatattataccagacatatcaagtataactgaatggatcatttaactggcatttgtttcaaaaactcccactccagcttttgcctggctgtcatgatatgccggcaacacatcctgtgtttccctggcttctgtgtccctcattggcatttggcagtctcatgctcccttcccaccttcaggtggacacttagtcatcacgacgatgaggccatattcttgcgtctctttttggagaagtccaggatgccaggtagctgcagagggaaggagctctgtgaccattttagccaggactcaggccatcaattgcaccatcagctcttctcttattttgagtgtttgattatggctcccccctggcacatctacatgttttgtaactatgtcacacagggagatcggctttgttgaatttcctgtaacttggatagagaggagaaaaaacaggaaagggccctctgcgttgcatcctttaataaaagaaccacatgggggcagagagagaagaagctggaagtaagaggaaatggtaatagcagaattttaacacttagtttttctcagtctacctaagattttcctttagcaatttggagtatatagtcacaacttggcagcctagcaccaaagttgtatatcattgctgctattgttttactttgttgctctgcctaaggaattcactccttaggatgttgaagccaggcttatgaagaatctccatggggaaactggtatgaaaatgctaggtacctcctaaataagaagtaatgcatttacttcttgcagaaacgctgttgcttttgttacttatttgtgtgtgtgtttgtgtgtgtgtgtgtgtgtgtgtgtgtgtgtgtgtgtgtatgagcttttctctttaaactaagcaggatataagcagaccccacccagcttagtgagtaaattcataccaaccattcaaaataattaaagggaaagaaggacttgttaagtaaagcaaataatgaacaagtctcaaaaggcaaaagccaaataatgagaaaagtcataggcttaacctcattttcactgcatttggtaaaattgtttttatcaatataaacaatcagaaattgaggcttgaggcagaaaagggatttattatctaactaatgtcactgaaaggaactgctcaaggtggtcatagcactggaaagaaagaagcagccttaattctcctaacattgccgtttagattagttggagacaaattcatttttcattaagtcttttattcattccacaaatatttcatgagcttcaaatgttatgtgcaaagcaccatattaagtgtggagtgtaggcaaagtaaataaataaataataccgaaatgataccaaaaacaaaccccccaccaccaacaaaaaccaaagcagaacaaacccatttataatagcatcaaaaagaatacttaggaataaacttaaccaaggaggtggaaaacttgtacaaaaagtataaaacattgctaaaagaaatcaaaggtaccaataaatggaaagataccctatgtacatagattggaaaatttaatactgttaaaatgtcaatactacccaaaacaatctataaatctatgtaatcttgatcaaaatctcagtggcaattttgcagaaatagaaaaagctattctaaagttcatgtggaatctcaaggaaccctgaatagtccaaacaatcttgaaaaagaagaataaagttggaggcctcatacttcctagtttcgaaatgtattacaaaacaacagtaatcaagatggtgtgctattgacataaagacagacacatagacaattggaaccaaatacagagttcagaaattgaccattgtgtgtatggtcaaatgattttcaaaaagagtgccaagacttcaccatgggtaaaggacagtctcttcaacaaatgatgttggcaaaagtggataaccatatgcaaaagaatacagttgggtcctaacttcatattatatacaaaaatcaattcaacattttatagttttagttattactcttagggtctaaaactataaaactcttagaaggaaacataggaaagcttcaatgcagtggattaagcaatgatattggatatgacaccaaatgcacaggcaacaaaaacaaaaatagacaaatggaactacatccaacttaaaaacttcacatcaaaggaacaattaacagaacaaaatggcagcctatgtgatgggaggaaatatttgcaaatcatatatatgtagttaaatccagaatatataaagaacttctacaattctataacaaaaagatgacctcattaaaaaatgggtgaaggacatgaatagaagttctccaaagaagatatacaaatggctaacaagcacatgaaaatatcacatgattcaacatcactaatcataaggggaaaatcaaagaaggtaccaataaatggaaagacatcctctaaaagattcatcactaatcataagagaaagaaaataaaaaacatgagctatcaccttatacccatttggatggccagtatcaaaggaatagaaagtaacctgtactgctaaggatatggagaaattggaacccttgtgtactgttggaaggaatgtaaaatgatgcaactgctatgaaaaacagtatagaggttcctcagaaaattaaaagtagaattaccttatgatctagcactctcacttctgtatatatatctgaaagaattcaaagcaagatctggaagggacaatttctcacttatgttcattgcagcattattaacaatagtcagtaggtagaagcagcccaaatgtccatcaatggatgaatggataaagaaaatgtggtatgaaatgttatgcagccttaaaaaagaaggaaatccctgtcacatgctacagcatgaatgaacctctaggcttaattaaatgaaattagccagtcacaaaaggacaaatactgtatgattccacttgtaggaagtaactaaagtagtcaaaatcatagaaacaaagtaaaagttggtgatgatgtagagtatgggttttcttttgggttgtggagtggaggcccattgcttcactgggtgaatgagcagcttttctaccagagcctgctgtttgttcaacaggcctgtaaacatacctctgtgctatgctgagtcctggtactgtgatccagcattgggcacccgggactagtctcttcttttcctgcctccttcttcctgggtattcataggcatctgcctatttacttccaaattccaagggagaattgggctcataaatcttcacaataccccagatgcattacagtgttactcactggcattgttaccttaatgcctctctaattatcttgtgtgcccagaccatagacacttcttagggaggaagagcaagagcagaagaggacagccacacctgcatcactcttctgtgtaagttccatctggcacatcctcttttctctttgggagggaaaagtggctcgttttgcccttagacccattcttgcccatactctgctttgctgtctatcacaggggctgtcatctgtgggggcagttcccaagctccttgaccagccagcttcctattgggtttgaccaatgggaggccctgtcaggagactggaaggtggagcaagtggtaagccagggtatctgtccctgtcttctctgcctctggtagcttctctggcatgggctgatctctgctgtggctccaactcctcctataggacatggcctaccagggcttagttttagttggtgaccctcgtcccagtgtccccattgtctttcagtctgagagtggtaatgccttcttattcttgcttctcctgtgctgtatatccttgctgtaaattcaattcccagcattgcatttcttcttatgtagatacttgaagcagttcctattttctcggtttgaccctaactgatgcagttctgtaggcctttagaaagccctaagtagttctatggaatccacccaagtgtccatcaatgatagactggataaaaaaaaattgtacatatataccatgaaatactataaagccataaaaaggaatgagatcatgtcctttgaggggacatggatggagctggaagccattatcttcagcaaactaacacaggaacagaaagccaaacaccgcatgttctcacttctaagtgggagccgaacaatgagatcacatagatacagggagggaaacaacatacactggtacctttcgggggtgaggttgcgggagggagagcattaggaaaaatagctaaagcattctgggcttaataactaggtgatgggttgataggtgcagcaaaccaccatggtacacgtttacctatgtaacaaacttgcacatcctgtacatgtaccccaaaatttaaaataaaaatttaaaaaagccctaagtagttctgttgaaaaaaccatttactgaaggaaagcaagattggaaaccaacagtgtcaaatttttacacatggttcagtattagttatagtattagttagttgtctgctgggtctgtagccaaagctgaaagcaattgatgacaatgtgaaggtaaactggttcatgtttgctgagtgtttttttacttgtggtagcatataaattgtgaaatgggatggaaataaatgctggtatcttagactttattttagatcattatgatgataaacatggtgttttcatattatagaaacttctatcatcataactcagcatggatagtctatccagtttaataagactgtatttattatatgagcaccttgatggtctggcatcaggccagacataaactagaaagagagcccagtataagctgaaaagcggtctctcaattgggaataaaaagattaaaaactgcagattacatttagtctgtaaccattttttcattttatttgagatttttaaaaagtatagtagggctattgtgaaaattgtaaatgatggagtcttttattttaggagtctttcattcctttttggtgtatgctggaggtgccccaacaagctgtcaaatccactattagcttcaagagttgggcattcccactcaaacttagtgttaaaaacattattttctttcttctcagtttttaagctcccaagaattactgggtgggtaagaatctagtgtttttctgttgctcatataacaccatctgggtttccaagaggtacactttggcctgagagaatggctgttgagtggtatagaaaacatcaaagtcaaaacagtaacatattaaaaaatattggttcatctaatacacagggtttgggggttagaagctaagatcactcggttcggttcctgccatcttggagtttataatctactggaaaatgcagacaatcaggatggtaactgtgaagtttcggggccttgggagcagaggaaaggttgtctggacagatctggaagctgaaacttgaaagacaagaggaattcatttgacaggagttgaaacagtagtgttctgggcagaggctaccagagtatgcagaggtttgaaggcatgaacaatgagagaacatattgtctcatgagaaatgacacagaaatattttaaagttgggtctttctaaaagtaaaataacagctttaaaaaaaattgtttttttaaccccgcctggaagaggatcattttggtggttgttgttgttcaacatgattgaatatgattgggtattattacttgctgatgggacttaattttctcttgtttaaatgtgatccattatcttgtgtctagaacatattaaaatgacttcaaaatgagaaacaagggaaccttggttacttcagcacaaacatccttgtttattgagctgacatgaagggtgctgggatattttaatattacgataatatagatgcttaaatctcagggttaaagaactagattagtcctctgtgatgctgggctactcagaccataaaggtaactcagtgtttactgttatgtttttctattcttatcctgttgtgtcttgcctcctggcttctctctttttctttttttcctcttctttccttccaactcaaaactcatcaacttgcaatacccctgataaaactcatttatactgcttaccaaattttctggcttcagccagctgttcagttttttttattgtggaaggccccaaactcttctcactacttgttctgaagataaattagcgacttctaaataatgcagtgaaccctaattctctttgattagtagcaagttagatgatagtgacccattgaaattggccatcagcataaataatgagtgaatgaactgataaaatgcaaagtcactggccatcataaatcaaatgaaatccactttctctggaagtcactgaaattagaagtccatgctcctattaattattttgccttctgaagacgacagtgttataaatcagccttgaaaggcccttcacttagaaagctgaaggagtacggctgcctgcaaattgctttgtgtacgcacctaattgtttcttaagtaattcacctttgtagcattgcttcaggaaacgaagaaggtcccttcggttgagatccatgacttgtagccttaggaatggccttgagaaggctctctggaaggtccaaattggagtgggcaattccccacccccttctctagaacagatatcctcatgttctttgtcttacaactcagaccccatcaggtgggctggcatttttggagtggtttgctatggcaggatccaaaaaaaggctggcagtaggccctgagccatttcatcatcttgtctcaacttaacttccagccaggcctaagaagccaagcttcactagaattcagtgaaaaccaagattttaaaagttgagaaaaaatagagattgaaaactctgacttctgaggttcattgtaaagagttgttgtaatctgcatatattaggtatgaagtgacacataatttttggtaaaaggtgggtgggaaattatattcatttaggagcctattttgcaacagatattttaaaaaacaacactttttggaaaagaggttaattggatggtaggaaatgttgtaaattagtttcatttaggaccattacctgtcatttaaagttctgaatttgagactgctgattaaaaaaaagcaaaacaacaacaacaacaacaaaaaaaacaacaaaaaaatagtaatctcttgggtgtggtctcaaaaatttggtccagctttgagatgtgatcctggattgttagcaaatctattcagagctgacaaggaaattctctgttgcctattgagtgtgggtgacttttgctggcctctgtagagagatggatgggcaggcttgtggaggtgaagacagacatcagtaggcggtagctcctgagacttccagctgctagttaagtatatgatgagtgttcaaaactagctttagtataggctccatagatgggggttgtattagtccgttctcatgctgctcatgctaagtaatttataaaggaaagaggattaattcacagttctacatagctggagagacctcaggaaacttacaatcatgtcaaaaggggaaccaaacacattcttctttacgtggcatcaagagagagaaatgctgagcaaagggggaaaagccccttataaaaccatcagatctcatgagaacttagtcactgtcatgaaaatagcatgagggaaactgccctcatgattcgattacctcctactgggtccctcccacgacacatggggattatgggaactacagtacaagctgagatttggatggggacacagccaaaccatatcagaagtggaatgaagatagggtttttaaggaaaactcattcttacttttctcattttctaaacttcctatcatctgctgcaggcctgcccaattcccctagtggccagtacagtaaatgtacatcctggccttggaaaatgaaaatgatctcctggattgtaagaagcacattctcttacttctttgtgttgtgataatcagagtgtcctggcatgttctaaagcatccacctaaagaagaggggtgtgtgtgtgtgtgtgtgtgtgtgtgtgtgtggtcacatgcacacacagtcatctgcacagctgaaagaacaatctgctttcaagtgagtggtgcaaattctcatgtgtgagtgtgttctggtgttggggttagttgctgctaaatcatttgtgcatctgaataacccattctcaaaactaaacttaatgatgtataattgagcattatgtcatgaagtagaaaggagcaattgttccctgagatattgaataccaaatgcaaagatgttctgggctgtgtccttgaaaccagccgactctgtgatttcacagtgattccatgaggcattctacaccttcaggatgagaggacatcttaatcctctggacatccccagaactgcctatcccagctactgggcctccccaactcttattagattcctacccatagtagtagaattctgcttgttgttggagaaggttggtggaagaaaatgcagctaatggtctttctgccttgcttctggaagtccaggagggccctgccagtggtctgtgctgcaggacagagtgaggcatctgtgggcattccttgcctggcagctgatattgtgtgtctctgttggtcctcattcatctagcttgcgttttagagttgtggttatgtaatgggggcgtgtaataaagatttgttgattgttggacatgctgtgggagtgcaggaggagctcatgcgaatgagtggctctagtatttttggatttgtttctgaggtttgtacaggataggcaaagtctcgaccatctataagactgtcctcctggcatgtgtcatttattgctcaaggtttctggattttagaacatccttctttgcttgggtgatattcccctgtgtggtatataatcaagtaaccatatgtcctggtttccctgggatagtctcaatttatgcctatttttctagtatgattattaatattggccaccccccatgccttttactctcaaaatatccagatttggatggccactttctatataatactgaaaaggaatgtttatatttgttgtcctagtaccatagaaacagtggcatattgaaataatcaaggctttggaaaaatgaccaatttatttatttatttatttatttatgttttaattatactttaagttttagggtacacgtgcacaatgtgcaggttagttacatatgtatacatgtgccatgttggtgtgctgcacccattaactcgtcacttaacattaagtatatctcctaatgctatccctccccactccccccaccccacaacaggccccagtgtgtgatgttccctttcctgtgtcctgtgttctcattgttcaattcccacctatgagcgagaacatgcagtgtttgatttttcgttcttgtgatagtttgctgagaatgatggtttccagcttcatccatgtccctaaaaaggacatgaactcatcattttttatggctgcatagtattccatggagtatatgtgccacattttcttaatccagtctatcattgttggacatttgggttgcttccaagtctttgctattgtgaatagtgctgcaataaacatacgtgtgcatgtgtctttatagcagcatgatttctaatcctttgggtatatacccagtaatgggatggctgggtcaaatggtatttctagttctagatccctgaggaatcgccagactgacttccacaagggttggactagtttacagtcccaccaacagtgtaaaagtgttcctatttctccacatcctctccagcacctgttgtttcctgactttttaatgatcgacattcgaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgttggagttcattgtagatcctgggtattagccctttgtcagatgagtagattgcagaaattttctcccattctgtaggctgcctgttcactctgatggtagttccttttgctgcgcagaagctcttgagtttaattagatcccatctgtcaattttggcttttgtttccattgcttttggtgttttagacatgaagtccttggccatgcctctgtcctgaatggtattgcctaggttttcttctagggtttttatggttttaagtctaacatttaagtctttaatccatcttgaattaatttttgtataaggtgtaaggaagggatctagtttcagctttctacatatggctagccagttttcccagcaccatttattaaatatggaatcgtttccccattccttgtttttgtcaggcttgtcaaagatcagatggttgtagatatgcggcattatttctgagggctctgttctgttccattggcctatatctctgttttggtgccagtaccatgctgttttggttactgtagccttgtagtatagtttgaagtcaggtagtgtgatgcctccagctttgttcttttggcttaggattgacttggcaatgcaggctcttttttggttccatatgaacttttaaggagttttttccaattctgtgaagcaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcatgtccgttgtaagttggattcctaggtattttattttctttgaagcaattgtgaatgggagttcactcatgatttggttctctggcagagacacaacaaaaaaagagaattttagaccaatatccctgatgaacattgatgcaaaaatcctcaataaaatactggcaaactgaatccagcagcacatcaaaaagtttgtccaccatgatcaagtgggcttcatccctgggatgcaaggctggttcaacatatgcaaatcaataaacagaatccagcatataaacagaagcaatgacaaacaccatatgattatccaatagatgcagaaaaggcctttgacaaaattcaacaatgcttcatgctaaaaactctcaataaattaggtattgatgggacatatctcaaaataattagaggtgtctatgacaaacccacagccaatatcatactgaatgggcaaaaactggaagcattccccttgaaaactggcacaagacagggatgccctctctcactactcctattcaacatagtgttggaagttctggccagggcaatcaggcaggagaaggaaataaagggtattcaattaggaaaagaggaagtcaaattgtccctgtttgcagatgacatgattgtatatttagaaaaccccattgtctcagcccaaaatctccttaagctgataggcaacttcagcaaagtctcaggatacaaaatcaatgtgcaaaaatcacaagcattcttatacaccaataacagacaaaaatgagcgatttaaacttactccctggcatgtgacctctggcaagttagcttctctgagcctctgtttctttatccaataaatggggatcgatcattgcacatccctcacagatttgtgctgaggattaaataacagggaaaagtcccagcagattgttgggcacataggtaggtagaggataaacatttgttcttttcctcagaatatgccaagaaacttggcgggttgggggccagaggctttggcatgtttccgaacctcctttccagttgatgcaggcagttcagtcagcatcaggtgtcacaaaaagagagagaaaaatcatcctctcaccacctggtgtgggtgagagaaggtcctctttgagggaaaacctctccccctaaggctcttggaatgccccatgtaaagagatgcaaaaagatatccccagaagagtgagaagctgaatttgctgtttgctcaaacaaaggattgattcagcatttctagcaaaaggagcaggaggcttgccagagggccaataaataactttgcctttcacatgtaatataatggtgaaagtaatctattggtttgggagcctctatctcttcatctgcgaaatggggatagagatcatagaattaaaggaggccataaagataaagcagtgttgcaaactgtagatgcagggcaaatcatgtttttcttgtttatacagaagtaaagcaccaaatgagctgaacactatcctggggtaaaatgaccgcatgaagcaatacacataagatgcacaggtctttcagacgatcttcattcatacgcttgctgtctttcgctaatgctgcaggagggcacacacagttctgttttactggccctacagggattgctgattttaagcaagttgtgtagtttcatggagattactattcctgttcacatttttaattagaaagagaaaaaggatttatttttctcagggcttccagcccagatggctcaaagtctatggaagaagggtcccgagtgcaggtggccaggcctggttgtctgctgtgatgctggctttatgtgacctttctggctgcctaggtggggcacagattctgaggcccccccgtaccagcccaccagcagtgccctggcccctctgtctactcagtagaagcaggtaccacatggggaccctgtatcaccgcagtaagtggcagtatgcagctcatgctaggcccggtgaaaagatgctgatagcttgcaggagcccttggaaggacaagctaaaatatatccatatgtgctcatgtctgctccttctggtacctgtcgcacccttcccttccccatcttctcttcttccccctctccactaattatcacagtacagcctaacaatgcataaggctctccacccaaactaggtgggactctgtgctgcatttatttagctaatacttcacatagcacttaatgtgtgctgagtaacagcagcattcccttgaccaagtcacatgccattgagagtgggagaggctgggattagagcttagccagctgatgccacagtccttgctctacattgtttttacttcccatccccctcctttctaatggctacctttccattcatctggtttgcttgttgtttgttctataaatttctgaaaatactatgaactcttaattggagaatgcttgaagggaaggttgccctgccatgtctttttatgcattgaaaattaaattttaactacacaggtattctccatactaactgctgaggctcagttctttttggctgctcctctacccctaatctcttccccagaagagataaccacattaggaatttgctacattgacttctgcttcttctgtgaatttatatccctctctgccacaggcacgtttatttatgcatgctaaagaaagtatagtgctgtatacattcagcagcttgctgtttacacccaaaggtatgtcttagctatcttttcatgtcaatacatgtaaatatacttgcactttttgacttgtgtgcaatattccatagtgtggctatgccaaagtttatttgatccttagctttctaatgggcattttgggtgttggtcatttttggtgtcacataagtaatgaatggccttattatgggccttttgtgcatatgtacaggtgtttctcttgagtatgttctaagagatggaattgcttaatcatagggtttgcacattttaaatggtactggatgctgtcagtttggcccctgtggtgatttttatcagtactcacccctcccggtgatttatggaaagtattatttgaccagctgccctgcccacatttggtattagcatgctttcaaaatgtttgcagtctcttgggtatgacatggtacatctcactgccatttacaattttcattttcctgccaaatttgaaaaataatttcacatatgtattgtcttttttgttgtgaattgcccatgtatattattggttcatgtttctgttggcttgcatgacttttagttattggtttctaggacatctttatatattcagggcatacacacacacacacacacacacacacacacacacacacacacacacatacatctggcctcgatgcctcatacattgcaattattttcttctaatttgttgccattcagctttatggtaccctttttatatataggttttaaattttgatgctgtcaaataaacaggtcttctctgttatgctatttatgtctaatttaaggccttcctgaccttttggctgtaaacatattctcctgtatttcttctaaaactttgattattctaattttaccttttaggccttgatccattgaatttttttcccttggtgaatggttttatgttaacgttgatgttaaaattaatatatttttccccaaatggatacattcgacccaacaccatttgtttttaggtcattttgctaagtattttgaaatactgtttttgttacatataaaatttctaattatacagaaaaccagactctctattctgttccgttgatctatttgtctatctgtttgctattagaagtattaaaaatagtgtctaaactggctaagagtatttcacaaaatttatgagaggagcccaagaggtcgccttgtgcaagaggtcaccttgctctttgctggctgttggcttcaactgaacagtaatctctagagcctgaggactacgctcgattcctgtgttcttggaaagctagatcattatgatgtttctggtttttttttttttttttttttttttttgagacaagtgtcttgctcttttacccaggctggagtgcagtggcgcgatctctgctcactgcaacctctgcctcccaggttcaagtgattctcctgcctcagcctcctgagtatccgggattaaaggtttgcaccagcatgactggctaatttttgtatttttggtagagacagggtttcaccattttggccagactggtcttgaactcctggcctcaagtgatctgtccgcctcggcctcccaaagtgccggggttacaagcatgagccaccacacctggcacattatgatgtttctaactcatgctttgaagcccaatgttgcttgtgtgatacattttattactaacaaacattggaacgcttctcataggctttgaggcatgtgagtcaaagtgatggtgacagggtgtccatcagaagatacaggttctaattttaattctgccctaagttctgtggccacagattacttaccctgcctgttatacactggggaagaactcggattgagtagacctagcatcctggcttgcacctgccacttattgaacatggggtttggggcaagtatttaatttctctatctcatctgctaataaagatattattgacctctcaggatggttctaagagatttttatagaaataaggttataagatagcattttgttaactgtcaggtaccctggaaactggaactatatactaatgtgtacaagcttcattttcattttggtccaatgacgataataaatctttgtctcacctgcctcagatagctgttccaatcatcaaatgggatgtgctttgataaaattgaaatgtcatacaaattatttattgctgatgaataccaacaggtggattggaatcagcaaatattaaccaagcccatggggttattacagtgaagcagggtcatattagctgggtatcctcaggggagaattgttggagcgtgatttatccatttataggggtcctttttactcacttgggtgaaaaaaggtgtaaagttggtcctttgaaagactcaaatggtctgttaagtgtgaataatgggagaacaagtgctgtatggagttcttctgttacaagagtcaagaggcagagtgggactggctgcagtattccttgtgttatcactggctatgtctagagtttttcaaattaaaaaaggaagttttattttttatttgtttataaattgtgaaatgcttctctttttctctttccctacttacctaaatgtaagaacactaggtcattgaatattaaagtgaaagactagaacaagaaaaaaaaagatagtttcttgggatttactattataatggcaacagtctttatccctctagagggaaggtgctagttatggtggattcttactgtggtggcccccaatgaaccacacttcctagtagttcccttttatatctagttcccttttatggtgactctggacttggcaaatgggacattagcatgtgggatgcaagcacaatcttagtaaatgcttgcacattggagctggtcttcttggaatgcttgctcttagaatccacctgccaggtaaagaagctctacctagccaatgtggagagaaagagctcacagcctccagctatcccccccaagattcttgagatataagtgaagccatcttggacgttccaattcatgccactatctgacaacaaatacatgaggggcctcaaatgagaccagtagaagaactgagcccctatcaacctacagaattatgggcaggtaaaatagtggttgtttaaatccactacatttgttatatagcaatagataatcaaaaccttgggttcacacacacacacacacacacacacacacacacgcacttaagtcagtttaatgtttgagcatgaaatgatttttcatatctgagaagttggtgtttttggacttgggttcaggctactttatcaggaaatacttttatttacttcctaaatttagttcagactcaagatggagcattgcatttggggtatgtccatttcattaagaaaaaggtagtgaaagaactacctgttttcccattagggcacagtcccttcccattaggtcccctcaatccagaagaggccatgaggggaggtgactgagaaaggatgtttatttctgcagcttgcatgcatggagaacctggaagaatttataaatccatcatttcaagtcattaggcgatatgttggtcagtccaggagactctgttctcattaattcaggggagatttacttgtgtcaccctcattagtatttatgggatttatccacatcaatcggtagtgcattaacagggaaataactaaacctcctagggtttgttggcgctaataaaatgagctggaagttccagaaatcaccatgatcagaagtattctaaatcagggctgtaattgatcctttcaaagtaccctcaggatgtttttctgttcgcttcacttccagtggcatttgcatattagcatggtgtctacagccttagagggcagtccatttcttaccatgaaacgatgtgggagaacccaatggagtgttgaaaattcatcgtcagaccagggcatctatgtaaacaaagggttaattttcttataattctttttgtttggtcctggcttataaaaaaaaaagccctgcatgtaaatatatcttttatgtattctgaacataaagatagctctgtcctaccatattgatttattagattctctgacattttagttgtggtcgttatgttatatttatgagatgaatgttggattccctcattatgttatcctcatttattttacatacttttatggctggttgtgcatcgctttacagttaaagctttattgcagctgttagcgttggggggaggggaaggcaagtagttattgatcggaatttacatgtttactgttgtaatcatgatttatttaatctgtctgcacatataagcccactctctgaaatcaaaaatatatactgtatctatattttagatggtggagcattcattggcaccctcatgccctttggagtagagaatttggggatgatctggtgttctgtggatgagcacttttcttacagcttggtggtaaatggtgcagactttggagccacactacctggactcaggtcctagctgtactgcctaccggctgtgtggcctaggtcaaggtatttaccgctctgtgcttcagtttcctcacctgtaaaatggggatgatatttatacaacctcataaagttgttgtgagaagacaaccttggtaaaatgaacaacattggtaaatgcttagaatgctggacactggaaattatgaaatgctagttattacaactccaatgagtaggtggcgagctaggtagagagggaaggctcagctactttcagatgggaaacttgactttagttttaattcagcagagcaaggacacttagaatgtgcttgggtatcctctagacaagaaaagacttcattgagagctgaagaatagtcccgaaaattgatttttcccatatattattttttaatgtttttaaattttgggcctgccattagctagcttctaaggatttgaagctttgcctcagtcttctcatctatcatgtgggtttaatgttacttctctgcagcatgagatagtagtgatgtgaacagtgaactagaagtcaatagacaacttacagcctcaggcctgctactgcataaccttactaccttggcagaagacttaacttttaacggggcaaggtctctgtctactctttaaggttatcttgagaaccggatgagataatatttgcagtgttattttgaatactctaaaactctatagtaaatgttagggaacttctaataataccacctaacaaagttattgcaaagacgagatgatataatagatatgaaaagactgaaggaagccggatgtgctctatgaacctatgggatgtgctctatgaacctatgggacatgatgcaggttcagccctttaacctcctgttcccctgagtgtgagtcctaacccttcccaagacacagaggcctaggggaacctcaggctccctggattcttagttccaaggagttttaccctttcattcaacccatgtggcattaatatggtttataatatactatttgaccacatccttaggaaaaaaataaggccttcccttgtaatttccttattgtttgtttattgggtgcaagactgtgttttatctccatcatttaatggaagctacactttctgctctaatgttagtaactcaacatttgctttttacaatttacaatttggcagtgattctttgaaataatttacttttatcatcttgcttcagattttcaaagaataatccatctagcaaaacagttttatcctttctatatattcatttttgttttgaggctctttagcagaattaatgatttttaatcaaatttctaggccactcatcataattaggtttagaattatgaattatgtacagcttgccattatatcatacctccttgtggtaggtgagtgaattagagatcatcacaggatttccagagcctttcagaatgatttatgacataaaaaaatcttcaattttttcttccttgtttaaaatgtctctagaaaaatctgttttttttctgcctctttcttttaccctctacctgaaagtactgttgcttgtcagttttccctccaaatcatttggcctctgaaaaattttgcatagctaagttttaaatgaattaatcaaaattgaatctcaaaaacatgctgggtgaaataagtcatacacaagagtatttactgtatgattccatttacatgacactctagaactaatctggggtgatagaaagcagaataatagtttgttctggagagagccacaggataactttgtgggacagtggcaagttagaaatgttctagatctgaatggaggtagttctatgggtatatgcacttgtcaaaactgatcacgttgtatacttaagatctgtgcatttcattatgcaagtatatctcaataaaaaatatgaaaaaattaatcatgactcactggttctttacatatattattttagacacacttctatggtgattaaaatctatggaattcttgaggtgatatgatgtgttttccttgtatatttttagccagaatttaaagaaaaggatgttatcttaccataccagttcttctgaatcactggaggtttagaaaaaatttgtttgtcagctctgttgtccaatgatattcaagtgagtacctgccgtctgggttagcttttataggaagccattactcattctaaaaatgttcccttctcctgccatttgacttatatggaggaataatttcttggctaattttttttttgctttatacttctgaaatacaaattcactttttctaatgaatcattatcatgtactaccatcaaaggttattcactgaaagctgaagaaaaaagcaatgaaaactaattttgattgttaatggaaatgtatttttagtcctaaagagcttccctcagcaataattatagttatgcctcttgggtgtttttggacttttaaatttacgtctagtagctctttttcatttagtagttaatcttttaacagagctctgcaaatttgttctttagtctggcgttagaaaaggattgacagagattttatttcttctcttctattcaattttttcccctcctcatcgtgctggcagcccaggctactccccttattgggcaaccctggaccctgtgactagtcatatgggcagtgagggatcaggatggaaaggctagagagggagattttgcttttctgcagccagtggccacccatggctctgtgagccacctctgctccacacagcacagaattgtggcacagcaagtgggctcatcaaaggtgtttgtgggagatgggcaacactcagctttgtggcctacaactctggaatacacactcagcctgtaaggggactggctggctgctgcctttccctggcttcagacatccaagtacctgtaggcatgtggggagcttgcaaacaacaagatgtaaagctttggtagcaatgaagattgcttgttggttttgctgcttctttgctgatttcagagagaggcatgggcagctgagagggcatgagaagcgaaggggttctggcaggaagtttgctcaggttttgccctcttattaagaaacagagtacgtcaattaacctggccaacctgattagagaaagtgcaagccactgctgaggatcttgtttctggtgaaaattgacctcacccaggaacggccagacatttgggtatttgcaaagcactgctgaacattaaggaacagttaaaattaatcctgtgtactgcagctcctgagaaagccagcccacatgtcaataaatctagatctgtttgaagctaacgtcactaaatcttcgtcttgactgtttgctggtcgtgtcaagagctgcctgggaagatgaatttgaggggaggatgaaaaaggaactgtattaaactgcagctctgataagtttagttaagaggcaggagatgtgtccttgccatgacattcagtggctgatatttgtttccctttaaataatatgctgtacatctgtgagaatgatggtttggggctggtgacattgcatctccaccaaggttactgccgtctggacaggcagtctctctcctttctttctctatcctgcaccctgtcaataaatatcctcttgtctgagcaagtgagatacagatttttattttttttttgagacggagtctcactctgttgccagactggagtgcagtggtgcaatctcagctcactgcaacctccgcctcctaggttcaagcgattctcctgcctcagcctcctgagtagctgggattacaggcacccgccaccacgcctggctaatttttgtatttttagtagagacagggtttcaccatgttagccagggtggtcgcgatctcttgaccttgtgatctgcccgcctcggcctcccaaagtgctgggattacaggcatgagccaccgcacccagccatgatacagattttacagctaacaccagagcgtcttcatttctagaagcaatgaggttcaacccatgtagacacagtagggaagggtgaggggttagagagaaattaaagtgactggaggaagctgttttggttgtgaaactgtcaaaggaaccccaaagcacccagtgggaaggtactgacactttaagaatttatccctaaaaaccccatttttacaagcaagatatatgaaatctggggactcaggatttagggttctgttttctcctgtgattcccctttctaggtgctttggtccttgctgtgatttgcagacctatgatctttggaagcagtcagcaaactttctctgtaaagggccaaatagtagctatttttggctttgggtccatatagtctctgttgcaactattcaagtctgctgtagtgtaaatgcagtcacagtccattgtaaatgaatgggcatgtctgtgttatggacaccaaaatttgaatttcatataattccccaggtcacaaaatattattcctcttttgattttttttaaccatttaaaaatataaaaactatccttagcttgcaggctgtacaaattagatggtgggctagattgggcccatgagctttagtttgcttacctctggtctatgatttgctctgtcttgttattttccttttgtcattgtgaggtgttggctgtcgtcttggtaggaggatgaggacaccctaaagattaagttcatggcctattcaacaaggagacagagtggatgggaatgaagacaatgctgggctctgaggcagacagtccaggttcccacaccaatcccccattaacacttcctagctgtgtaacctcaggttggtcacttaacctctctgagctcctgtttcctttttctttttatgaaatgggggtaattatattttcactgtctgtattacatgactatactatagcccaagtagtcaagagataggagaatgcctagtaaacgttgtcattatatgaatgtaaggctttgggattatttgcactgcttcaccaatgcagactcttattaactctgattgttactagtattaaagcattatgtcttttgtatttcagctacaaaaacagaatcagaatttgaatggtgtaaagaaaagatactcttgttttttcactttcttagactctgatgttggctgggcattcctgagcctctcccgcttgtttagcgatttctcccagtgtgtccagatgcttggtgtaactgaagggatcacatgcagtttgtgctgtcccactgctcagaaagccccgccctcctctctctctccatcctggctcaccttcaaggcctggctgaagtgccgtctcacccaggatttctccaccagggtccttaacacatgcagctccgtcctgtgtgaatggcttgaccccacccctggcacacaccttatagaaaggacatcctgtcctcccaaagatgtacaggttttaagaaaaagggtaaaggcaaataatggaggtcacaggtaaggcaagcaggatgtcttctggccaagttgagtgcccctgaaatcactgaatgttgcccaatgggagaaggattcagatatgaagggatgggggtctagagaacttgttttctgtgacagtgttccatctatgtcatctgttacacttctagaacattttcacatccactagctctttgatcctataacaagtctttgaggcacagggaacattttaatccccatttgaccctgaggaacagaggcccagagaagctaatttacctgtctttgcatcatacagatggttaataatgaagttgagactggagcctagttctggttaccatgctgcaccccatggccaaccccagcctgatacaggcccatattgctgccatatgtgatattccgtcttgagggtgagggcacatttctatatggatatatcaaactagctgtctttgagtatgttagctcgtcttatctttccatcccagaatgcatttgtggagcaggtttttgagcaagagagcctgttatcacgtattttcagcttcttctattccggtcatacctgcattatgtaaatatgtatacacagagtgtttgcttatttattcggtctgtggtgggaaaaccaagtgcattactgattcctgggctgtgcttttcagcctaaacactttctgcagctcctcattgctcacttaatgaagtgtgaactcttcaggttggcttttaggttctccgtaatctggttcctgcctgtcttccccatctccccttccatctcaggggaagccatctgcctcttcttgatccaggctcgcttttctgtcctgtctcctctgtcatctagaactttgatccaccactcctctttttcatgtgtcttcaactctccctctccaaagataatttcctgtgaatctgtcatactctatgtgctttctctactcttaaacacatccttgatcctaactgtcccttacactattgtcctctcccctcttgctgcttcgtttatatgaaccagcctttctcacctggggctgtgggtgataactaagctctgatgtcctaaggaagggacaaactgtcacctgaaagccacatgtggccaccatctttttttgtagggcttgtgggctaagaatggtttatatattttttgaaggttgaaaaaaaataattcttgacatatgaaaaatagataaaattcatatttcagtgtccacaaataaagttttattggaacacagctgggcccattcattttggtattgcctgtgactgctttggcactacagaagcaaagtgtagtagttgctgcagagaccagatggctctttgtagaaaaaggcattgattgtgtataatgaattgatttctctgcatttagaaacatgtgttatgtacgacatttgggagaattaagaagtgagtcacaggaatcacattctgtgattcagatgaggaaaccccattgcaaaagactgactctctcccttattccttagacctttgttgtccggattctggaacaagcccttctctactggaatatgtcctttggagctctcccatgacttctcagtcaccgcatctggtgggcgcttctaggtcttatcattccatcctctctgcagcacctcccactgttgaccagcttctacttctgaaattctctgttctgtctgcttagaccttgtgatctctccttgctgtctcatcctttgtctactctccccattcactgtttctttgtgtctcatctttagcaaactcccccctttcttgtagagtgcttgtagcaaaattgtgatatttacccctgtctccatgccgatgatttccagttcactgtctccccagctctgtcccactttccggggcatcatcttctctttgctgctcttctcgtgttcacttctctttggtccctcacacccctttgttctctgttgtcataagatttagaatctcagttatctgtgatgtatctcctcaactccaaatagtttatcagttgcttaatctgtgaggatattttcagcatccattcccatctccctagtccgaccactccttcagctctttcttatctttctctttcccaggctagccaatgaccatttcccctagctgttccccttcttccctgctgtgcagtcaggctgccacctgactctagcagacactttaggggcccccattacatctccttggctcacctctggtttcagtgacagctcccatgcagagtttcgcatgggcttagtttcctgctgatggtgtctcacaagttactgcaagagtctgtcttctttctgccccaggaccttcccaggagccaaatgagcctgtgcataagttcagtgtagcctgcaagtgcaattgagccagtgcctccatcaggggtaacctgcaactgatgggggactaaagctgatggattgctgcccagcctcttacctttcatgcaggcagctctgggaggcctccgtatgcttcttgggcctactggaggaggagtcatgcccattgccaagagcagcaaccttgataatgcaccctgatgttggattttcctcctcccctccctttcctgctctcttgggtcatctcccaaataagcttcctgcccccgtgtcctctcaggctccactttcagtagcattcaaaccaagacacagaccagtcttctaaaagcttctgcccagacatcttcagtggcttcacaagctccccaatatcggactgattgtgttttaaaatcctaggctccctgggtttgtttgatatcagcttatcttactaattttatcttcccctactcacctttaccctttgttttcatcaaaccaggttccttaagggcagagattgtgtcttattcatctttgtttctccatttgctcaatatccaagatctgaggaaactgaaggcaaatgtatatttttagtgagcaaattaatgaatgagtgaattgaatgtattcatcttcacatgtgcatccattgaggcattcctcctcctcattgcttagtagtgatcttcacctccactaacttgacaaagcaccccatctctaccactgtacggtacttttaaatttctactttatgtttttttacgtgtcttaacttctaatatataaattccttgagagaagcgatgttgctttattttctttatatttccccacagatcttatgggtacatggttccttaataaatgttggttgaaagactgagagaacatctcattatgtttccagacattctggggccttctgattcgttctattctctctctctctctttttttttttaatttttgagacgatggaatctcgctctgtagcccaggctggagtgcagtggtatgatcttggctcactgcaacctccatctcctgggttcaagcgattctcctgcctcagcctcccgcgtagctgggactacagttgtgtgccaccatgcctggttaatttttttgtatttttagtagagatggggtttcactatgttggccagggtggtctcaaactcctgacctcgtgatccgcctgcctcaacctcccaaagtggtgggattacaggtgtgagccactgtgcctggctgatttgttctattctctgttctccaaacatgttacatgttttctcgttcccatgaattgaagctatttatttctcctttgctttttatacatgcttcttacagtatttgcctgtttacctataaaaattctattcttccttcaagtccaagcttaaatgccatctttttcataaagcttttcccaatccaccctgttaaatcatcacctcttctgcaacacacgcctgttatacatttgtattattctgctttatgtagcataattttatgtggcttgtcttctctccttcttagagacaataagtgtattcagggcaaggctggttatgtcctcattgaatccagtaccttgctcaatgccctgcaatcaataaatatctgttggaatgaattaatttgaataggttaaataatataatcatgcttttgcatgcacatcaccttaactggtgcccctgacctatttttggtgcatgtccttgagtttcattttggtaatggaagaaatatcaagcagaagaaaagataaatacccagagctggtcaacatgatctactgtgtttgaacaggaatattggaacataacttctaagaatgccatttcaattatttgtaaaatatttaaatagtataatccaatttacattctatcatttctaacagctgtaaaatttactttacaccaaagttagctcaatcactttaattcagtctggaaaaacagtacaaatgaaagcttaatttgtatttaatctcctcttttgtttctacattattgccttcgaatcattccttttagtgattgagatttaaaccagagagaggaaaaaagcttgatgaaatatttgagaagaatataagccataatgaaaagtatgaagtcaatgttttaaaattccaactggctttgttctttggggtttcaattcatggcaatgtttttgtggtaaacctgaggtatgagatatgtgggttactttgtcagaatcacagggctataactctcaggtatttaaaactaggtgattcatttggagcaggttacatttatactctgtatatgaagattggcagggaatacaaaagtgcataattattatttagtgtgttgatcatactcgtatatttccaaatggctttatgatcattttggttagtttttctctctaagctctggcagtcttccagctaatgtcatcagcggggaacagcagcaaggagaggtggcagaattgtgactacctatggctttcctgtcactgtatagtatcaggtctgatgtggggttgggtggaggaagattccaggtaagggtagaatggccaaatgatgtgctacttcttaggatgaaacagccttctcttatttctctgttttccaggtggtggcatttatagaagtgttccagaggcccacacctgtccttacctgagcccttcttcttcatccctatacttaccacatcccaccctcacccccagcaaacctctttgaactcaagaggtggtagattgaaagaggcttcaatgaagggtacatatgccttagacttaattctgatcaataaatgtaagttaattaagtaaaagtcgggggaaagaaggggcttcaagctcatttatagccaagaagagttagagaagaccatagcattttacactttagaaagatgatttcagaagaagggatatgatgtgatgggccaagagtctaaaatgaaaaatagctaaagaggaattttcaacagtgccatcacattctcagaaaagaagaaaagggccaggcatctagacacctgtgtaactacatgggataaaattttaaaatggggcagaattgttacagaaatactgagttacacttaataagcacatttctctttgttatatcagctattctttatagcagctctgtgattttggtccaacatggagtagtgaccctacttcgtgaatgaggaaactgaggcccaaggattttagggacttgcctaaagtcacagtgctaataaaaggcagaattaagtttcaagagacctaggtattatggctccatagtgtagtgatgtttctacaatactatgctgtaaactgttggcaacatttttaacagggctgtcagaagatcaaagccacccagtgagctgaggtttataaaatatatacatctcccaaatatataatagtatatactaatgacagaggataagtcacagaagatgaggtcctctgctccactcactggaatgaatggaaagaagcacaacaacttaagttacattttggcttccaccttttctatcaattcagttcagtgagcctaaggccatccaagtgccacatctgtgtgtgcacatgcagataggcagggaatataatcatgagcaattattcagtctcagggccacatcgtcctagaagctcttgcatgccaatatcaatcacttagccatccaccagcccctggataatggtaacatgcacagggtagctgccagtattccctttaccatggccagcagcttgtgtgttctagagagagatagaagagtggtggttaccctagccaggcagttaagcataatgcagtgacaggagttactacctcatctctgaactgcttcctgctaattttggtgagacttttcaaggtatagactatacagaagtgagactgttccctctgggagctgctggtttagtgaagaagacagaaaacacatcagcggtagaatcagtgactgaggagtttggagaaggatgagaggcttcttccttatggggaaagatgacaaggccatttggccatttctttccttttctgtttttctttttcttttttttttgagacgcagattcactcttgttgcccaggatggagtgcaatggcatgatcttggctcactgcaacctccgcctcccgggttcaagcgattctcctgcctcagcctccaagtagctgggattacaggcatgcgccaccatgcccagctaattttttgcatttagtagagacggggtttcactatgttggtcaggctggtctcgaactcctgacctcaggtgatccacctgcctcagccttccaaagtgctgggattacaggcgtgagccacggtgcccagccagccatttctttttaaagaaagagaaaggtctaattggatagtagtgattggaccatggtggtaagatatgaggcctgattggaaagcagtgattggactctgttgggaagacatgagacctgatttgacagcattgattggaccctggtggtaaaacatgaggcctgattggagagtagtattggaccctggtggtaggatatgaggcctgattggagagcggtgattggaccctggtggcaagacatgcggactgattggagagcagtgattggatcctggtggtaggacatgaggcctgattgtagatcagtgattggaccctggtgggaggatatgagacctgactggggaacactgattggaccctggtgggaggacatcaggcctgattggagggcagtgattggacctggtagcaggacacatggcatgaagagaagcaggtgcagctgaggctgcagtcagcctgaagagtgtcctggggagctggctaaggaattggaatccttcttggggaggcagtgaaagttgatttgcttattttaagcaggaagtgatatgcttagatttatattttagaaatgtcacttgagggagtgatttagaacaatagactggaagggagaaaaggctggagaaggggacagtagtggaagccagtgtagaaattcagaagagagagacagaaagagaaggagagaggccctcgcgggagctatcttaaggtagatgcaggcataagaaaaaaatcgaaagaaaaatatcccaataacaaacacaaaaccccgacaaacacacagagtacctggtagacttctgcataagaggttacggagtcccaggtcctagtctagaactttctattcatgggcctgatatatagcccagggatctgcattttgataatctcccaggggcttctggtgcaggacgctagagctcttgaagttctcccttggttctgaccttcagcaaaagtaactcctcccttcatgtccttttctatgagactttcccagggggcctcatgacataacaagattcaataactacgattaagtgcttccttagtgtttggcattttgtgaagcactttaacaccagcccttttcatgagtgcctccgtgcttctcagactttaaagtgcatcatcagctgtgccccacccccaggatttctcattcaggaggtctggggcggagtgtgaaaatttgcttttctaacaagttcctacagagctgctgctggcccaccagccacattttagaacccctgctgtccaccactcataggaggggcagggattgttgtctgtatatggctcaggaaaccagagacttggctaggataagtaattttcccagagtggtagagttgcagctagaacctgtctgcctgaatctccagttcatattcttcaccacagtctcagcctttcatgatgcatgaccaggattggtggaacccattctctgctgggcttacgtcccctttccttaatgagctaaactgactttgttactgctttcttgaagtcttcctggaatcctctgccatgagttggcctcgtctgtgggcagtggaggtgtctgccttccagcagtgatttaagcatcctccaaagcatcttcccgaactgaaataccagagctgacatagtctctcaattcccaccaatacagttacccttttagttaaggctctgtctccaggttgtttcttagattgcgtgtgagctcctgggtggcatggatcacactgtatttgtgtttgtagctccacacctaatgcagtgctggactcattctaaacgggcagtaaattgagtagaacatgagtgaatgaaatatgttacttgtagggtataatagttggacctattaacctagtctaacaggcaaactagcttagaggataataggatgggtacattttgaatacctggaggtagttagtataaaaatgtgccaccttccttagtaaaagcaaaactcagaaccttccacagatagtgagactctcttgaaggggaggggctgatgggactcctgtcccaattttcctgtgatcattgctaatcgcattggtaccagggataagctgttttctcactctatccttagcacaaatgaagcagactggaacctttctcggggatgacacagggatgtcaagatgaaatcggaggagttcccttatccccctcacagggcatgcaacaggggtgtggctcgcttctttgatgccctgctgctgaaaccccttggggaagcatgcagacgggcaggtcatgaagagtgtttttggactccgaccccacagcagggtctagggttgaatgtttacagctcttgaagccccagtggcgtatgttacagtgtattctttcagttttgctgtctgcaggtggcttgtgttaatcagctcaattagaccctctggcttatcccaaggacagagggctttttgcatcccgtgttcttgccctagggtactggaaaaatcagattacatgtgggattggaggattggtgcaaggttttattgagtggtagaagtagctctcggtgaggtggatgggtgcaaagttttattgagtggtagaagtagctctcagtgaggtggatggggagccagaaggggggcatggagtgggaaggtggtcttcccctggggtagggccacccaacagctggactctcctcagaccgtcactgactgcccctgactgaattctgcgtcatcccgcctcaaaggccttgtggtgtctgctggtgtctgttggtgtgctcttctgctcctcttgatgtctagctgattgtgtctgtgcctgctagggtcttgggtttttatgagcacaggattgggggcatggtgggccagagtggtcttggaaaatgcaacatttgggtgtaaaaacaggagtgcctgttctcacttagatccatgggtacaagcccaagggtgaaaccctcaccagggaccccacccttctctacccagcacttccctgccccctcctgtatcaaagacggtaccaggagtgtagtctggctggcttccagggccccaggtgttctcctgctgacttgaccagccacctctcagagctctggagactgtcatctctgtctcaggtcatctgggcccttgcttagtggttcctgcttctatgcagtgggtgcgttccttaattcccagctccaggagcaccctcctagatacttggccccttccaaactcaggccaacggagacgtttctttcacttacctaggtctgctgtcttggacattgcttctcatccagagacacatctgttccccaggtgactctgacagacatagccttactcttcaaccgatctcacaatcccctgcccaccatcacaatatcctaatgcagtagcggtgtcagtcttataacttgagtgatgcagggtggtggcggcgtgaggagtgggctggcattttctcacaaggggcagcgaggcccagagtgtaaggaccacaggggtgaagcaggagaaggatcggacctcccgaacactcaattggctgctgcagaattttgcttccattagccctgcgtacctttgcccttagaaactctctcttcccaccaccaggttcctaccacacaattagagtagacactctttaatttccaaccgccttgagccctggaatctgcatcagcagtctggcattagccatggtcatttaccgcctcagattctaaataacatggtttgtgctgatggaaaatgccggccaggtccctatagatgtcactgcttgttgttgcgctgatgtatacatgcctatttctactggaatataaggtctgggggaagggaagagactgggatgaggctgagggcaagtgacctctcatcctttgttggtagttttcacaccaggatttggggtttgggttccttggggtcttatgaaaagccattgaggttgggaattttgcagggaggtgttttatttacctttcccctgcttggtgattctcagctctgaatgtacctttctgtatccacataccttgtggatttactttttccatttcttggaatgatgcaaaatgcctgggttatgacgaacatgggactgtattttctatatttcctttactgagtatcagaaagttatttgaactcacaacttgtttgccattcatgcttataatttcctggtatgattagcttcttctacacatgtgatccttaagaggaaaataaaatttccatgatgttagcaatattctcgtagatttatgcagtaggtataatatttaagctaattttataatgttttaaaaaaatcattgctgtttgtcggcctgattcctttgtttgcgtgtcatcagtgtccaatgagtagtatgtgtttcttccagtcattgttaaaacccaatatatggaaacagtgtttataccagcagctgttacaaatctggggctatggattaatgtcagtttctgaatgtagagtgctttagttaattccacccaaggacagatgatatcatctaggaagaaggaatatattagaaactgtcagccagaaggtagtaaaaggaggtgatatgttataaggagtactaaaaggtcattcaaagaagagatattgctaataactcaattaaaattttcacgctaacattttacaaatttctgtgtaagccctaaaacattttcaaagctagctaaattcataccatagattggaaaaacaggggtcaaataggattcacacaattcctttgtgagatgaacaaattgggataatctccttttccaggaagttctggcaagctaattcattgaaactcccttgatatctaggtgagagggtgggattttgtaagtacacactttcactggggattttctgttttctgtgttacactttggggcagggcaacccactcatttggtccttgactctcaggaaaccggtatttgctaagctggtgcatcactgcagttatgctctgtattttgctgcctggaaaacaaaaggatccatgttcttcctgcaagccaagaggcaaaacaaaaagtggagataaaggccgttagtggagcctgtacttggtgtaggagtacttccagactgtatgatgggataggaccaccatgctgcacagtcgggcagccaggacaggaaacgcaggaacagcaggttcatgagaggtcatctgaccatctgcctactctcctgtttgggaggaatgatactttcttgaagatgttcttacctggagtccacctggcttctcttagtagctctttctagtgttcagtcactgttaaggttcattcagttcttctcctgtccagtgaatataagcagatttctcttcttgctaatttttcccatagtcatggagaggaagtggtcagtatgtatggatacacatacatacatatttagcaatggctgtagctgcctccggtgtgctggtgctacagatttgatggtaaggaaaagtaaaggtggctgctgccctcctggagctcaccatctagcagaggtgaaggtcattaattataaaatcactcacataaacagatgtaaagtcacaatagggataatgaggcaggagaataagatctggaggcagggaacctaacgccgattcacgctgacttcctagaactgaatcaaaaggaaagccccaactttccacactaagtaacaaaaggacgagaggctactccctttgcaaatctctcccccccactacccctacttttctgcatggcagatggaaaattgaaagtacctctgattgatggctttttgcaaccaatcagacgtttgcataggagtgtaactttgtaacttcactttagcctctgattcgttgctttccacaaccagtgagactgattgcaggccaccacttcatttgcatggggtgaacaccaagtggccaatgagaaacctctaggaggaatttggacccccaaaagattctgtaaccagggcccttgagcctctgctcatcccactcctaccctgtggagtgtactttcattttcaataaatttctgcttttgtttgcttcattctttccttaccttgctgcgcattttgtccaattctttgtccaaacttccaagaacctagacaacttgcagtcaagaccctctcctggtaacaacaggggctaaggtttcagaaaaaggatatggtgttgtggtgggaccttgtttgaccgatggaggtctggattttcctgatgaagtgttggctcacctgggagctgaagggtgcagagttaactagaggaaaagaggagagggaagagcatcacaggcagagggcacagcaagtgcaaagcctcttgactggagggagtttggtgattatgaggaggaaccgaaaagaggcctgagtggttgttgaaggaagacgggcaaaactgaacctggggaggcgagcagggtcagttaatggaaggcctcacaggtggtggccaggaatcttattttttttaaatgtgaaataattatggaggttgtattcactgcaagccaaactcaaacttcttcttctcactgtaatataatcatagttcctttcctcttcaattctggggacctatattggaactttcagctgaggatttcaaactgaatttctttgttttttgaaattccttctgcaaaggtgtttggcatagaaatgaggacagcagctatagagcacctaaaattttctacaggtatctcaagatggagtgtcttaagagtcagaaattgtgacatgcatgaaaagataaagatatatgtcttttctatgtagcatgtacacaggaggcacttaataaatgcttgctgatgaatcagaggtgacatccagctctcaggaatgcaaaacaatgttttctgttttccagctatctgaacgttgctaacagagggcctggggaggagggacgggcacgaccgcatctgctcctctgtcctgtgtgcgtgtttggccacctgatgccaactccatgatggcacatttgtcttattaagtgtaagccaattcctctcccccttccagggccctcctgatggtggctgtggaggacagggatatgctgtgaaagcccagttattatggtctgtaaagggaggtggtggctgctggggaatgatcaaatgaagacaaatgcattgttaagtttttatggaccaaggccgcactttcattaagcgtaatttacataacataactgatgctcaaggccaaacagtccttgtgccccagtgacagtccctgacaacccatggaccgaggcctcatgcacaatcccccaggtcaggaaacctcctccttctccttgctagctcagcacgctggttgctccagtgctctcattttgacctctcaagccaaatgctgatgacatcaaagctacccattctactaccgattagcagtaaaaccatcgggcactctctgggcagagttcaggtgctatgttccttcctcttttcccacaggagttggcttcctggtctgaaccctccataagccctggctgggaattttcctcactgtgaccttgtgagcagtccctggttaccctcaaggattgtgccaagcaggctctgggttaacatcttggagagtacagagtaggctgataatcagcctatgctcaacagcacacccaagagttgaagatttctgatggcatccctggggtgctcagcagtggcctttgtctgcacccatcttcattacatgttaataccaccagagacactttgaggtcagccttttcaccttgcacggcaaagcaattatcatttcctttcattgcaggggtgggcgttggttatcacatgatggatttttgctggtaatcagaactttctgcccattggtcttcaagacatacttttgtgttgacatttacaaggtatgtgtcaggcagagccgaggtactgagtgagggaatgaaaggaggaggggggagaggatcattatattcaatttaatgacgacaatttccctacatttacaacttccagaagtaagagacaatagatgtgtgtcttctgcttgcatgtacaatgaaggagatgacatgaggagattctgttagtgggaatggtgatatattaccttaatgatttcattgcttgccaaataaaagaaaaattctcactgtagtgcaaagccctgtcctcatcaagctattcattgtgaggcgtttgttgttaaatcggaggcataaggaggggttttgaccttccataagctgcttttgaatttttatttttttcttggctaaattgatggtctgttttctttttttagtagacatacgtgaacatttgtatattgaatattgaagtttgttaatagatttgaagagctcttagatttttttggcaggtgggtgttgaattaatggaatgtttcacaatagagttcaatgaaagctcccctccactattatgctagtgtttggaagggcaggcgactttgtgtgtgtgtgtgtgtgtgtgtgtgtgtgtgtgtgtgtgtgtgtgtaggggaggggatgttttcatgtgagctgtggataaactgaacaaatttaattaaggtctaaactgaagtaggatcccatagtctaggtaggatccaagggactattttctcagggctgctggaggttggataatctgaattatagacaaggaggagtccaaagtcttagttcaaggatggcaccaagtgacaagtcctgtgatctagcagaagcagatggagaactaagaagaagatcagaaactaagatgacttggagccaactagaatgagatcatggatagacagccttgtaggctagacctagggacaggagaattagagtcttctggatttccttattacatgaacctgacagtggctgtttaaagaagcaatgcagggcctgacagtaactccttgcttggcttctgcttactctgtgtagtctgctttttctagtaggttatccagatttccaaagtggtggagtcaggtttgcatggtagagcttgggaactgaaggggaccattgtggtcatggaagtcatgagcatcattttccagtttagaagactgaggcctagggaggacagcagttgggcaggcccaacgaaaaatccagtttaggaggtccggggaggatagcagttcaggaggcctggggagaactccagtccaggaggcccggggaggacagcagttcaggaggcccagggagcactgcagttcaggaggcctggggagaactccagttcaggaggccgggggaggacagcagttcaggaggccagagaatgacagcagttcaggaggctgggggatgacagtagttcgggaggcctgggaaggacagcagttcaggaggccaggggaggacagcaggcatacccaaggcctctcaggcattgctgtgcttcctcaccctgcaatgctgccgccacatcctgttgctctctgtttgtttgattggagtggctctcctgaagctgggctgtttgcatgcttggtaggcccccttcctgaatgtgccagccagctctggagccctactcagtaactgtttcggatgtgatcctcatcagatatatttctacctactagttgtgtgactttgggcaagcctcttcacttctccaggtctcagcttttcgtaagtaaaatgttgcaaggtctctgtggaccctttcagcttaagcatgacatgttctgtaactaaggaggcccagttatagaagctcctggtgtagctgacaatgtgaatacagtcaatctcaggaatctgtggaaatggaagtgatggcttatactttggctcttcacccacctgaaagatcacgtagaggagttctctaggctgcaagctccttgaggccaggggccatgtgtcattcatttttacacatccaaagccatcaggctgtgtggtgaattgtgatgtttagtaaattgggactgactgaatatgaagtattacagaatttcagatgataagacatacttaacatagacattgcataagcataacacatgtgcctaggacatgcctcctcaaaagtgctcgctgagctccattgcagcagggaccacacctgtcttatttaccactaggtctcaagttccttgagcatgactaggcacatagaagttgtttggtatgtttgctgaatagatgaatgaataaagatatgacatgaaagaagcgtagttgaactttccaaggttatttggattatttggtgagagaatataaacctggaaaagagaagaaagtaggaaacttggtggcaatacacctagttttgctttccttccacccctaagctgtggctgaaatctcttgtacataacagaaagtgacaaccagcagccccatcttctagttgacattggtctgcagatggtttctagtgtatgactaggtaagtatagaaacagagcatatacattaggaaacttttacagaaattggacactgcatgacacccaagcatgtgattgctggatttgtttggctgaacagtgtatggaccagtttgtatattgctaaagtcataaatgaattgcacatggtgtatactgcacaccagtcctgtatggtaggaccacaaataggtctatgacatatcagggaagaaattatcctgcaccacataactagaaagaaactaggtgaaatccttggttttgtagcctagcagtcatatttttattaaaatattgatgatcttgtttgtcatgtaaagctgtttctgactcatcataatcacatattttctatgttgttgatttgagaaggactgaactagctacaccccctcagtcaaccaagttgagttataatctgtgtgacagtgtttttctctatttaaaactagctagtcttgcatggctatttaactcactcctttggcctcattagtattatcctataatcaaataagctaattaagctgtttcctatccactgatcagagaatattaaagctcggaaggtgactctagctatcctctgctccagctccttcatttttcagagccagttaaggctcagagaggttaagtaaagtgtctcaggtcacacggttatttataaaagaattgggactaaatcgtcagggccctttactcctaggttcttgtgcttttctactttatcctgaagtttaataaaattctttcagattttataacatccaaggtgtgtctctgttgtggtaagttctgggccgctatttgatagatgacctagaatggacagattttgcttgccaaataattatagatggttctacctttaagaaaacttggtatctgaaattatgaacacagggaacgaagaggtgattttatatataagtatatatacatttatacataaatgtaatatttatatataaatatatgatttatgtaaataataacaaaataatatatatgaatgaatttatagaaaaatactggctttggagagatgtggtgactgctattccttatagtctcaaaatgaggataaagctttacataaaattatgtattaatggaaaaataatggaaaaataggatacaaatatattggtacacgcacatttttagaaatgtatctataggagaaaatgagactcttctatgaattaaactagggagtgttgacggaggcctgggtgggtgaatttgtttcccccgaacatcatctctgtcttagcaggcttcagtgtggtctaactgaggtgttggcaaactttgacttgtaagccaaatcctgttgctaccttttttttttgtaaataaagttttattggaacacagctgcacccatttatatactgtcatctgtgactgtctttgagctgcaacttcagatttgtgtcattgtgacatatgctttatggcctgcaaagtctaaatgtttactatctggccctttacagaaaaagcttggtgacctctggtctagatgcatatctggttcatatcactgattctactaccataaggcagggggtcttcatttggaatctcacctagctgagttctgatagggaaggaagaaaatgaactttaatcaccttgctcagaagcctgttttaaaatccagtcaccagctgccggtttttagtttacctatgacctcctggagatcctgagagaatgaaattaaccacctctggaacaaacatccgatctttttattttttccactttcttaagagagtaataaatatagtcaatgactctggattctattactatgtaagagctctttaaaaacatctaaccatctgcttaatggccagtaatacgtttctaatggtcactctcgataagacacttttagttcactcctgtaatcgttgtccaacagccaagaggctcctgaagaatatgaccaaaggccagccccagccccagccctgtagccacagaggcctggcaacagtactgaagaaaaaaagagagagttctgagagctgcatgtggaaactcttttctttctcttgacactctccgcgtatgatgagttcgtgatccacaatagtggatctgaaaacttcgattttttttggcatttacacgttcaggtacagttgcaactagaggtcagtttaattaatatctgtcctttcctctcagatgacatacactgaaccgttgtcactagaaactccacatccctgatctgggcccagcagctggtgacagcttggcaaattatgaatttcctagcttaaaacagcctaaattgcagacaaaacaagccatcagctgagtaaatactgtatctctgtttagcttctgtaagaagaaggagattagcacgaatgtttagtgttcataattactagtaggaagcaaatattaggctcgggctgactggagattatttcattatatccaattaacacccacttgattattcttaattacttctgcatgatgacagaggagtaaagatgtcgtacttcaaatgtacaaataacatctgggccatcaacgtacatgtatttgtaatataatatcctgctcattttgggatggctaatatggtcttagcagagggatggaaaatgaaatgacaagattctggtaattactaagcgggtcttagacaagatgccaaaagtaggtattaggataaaaatgggccttttgtagcaatctagtttagacatgttttctttaaaaatgccttattacctttctgtgtaagaatttctttcttcctctgcccattgactatagtacaaagatataaatggaaatagctaagtgcaaactttccagaaaagagtgagctatatgtgtgtgtgtgtatacatgtatgtcaagtggtatgaatgggaatccctgctccaagggtgtttgtggagttttgagaaactgagacaaaatcagcctgtgtgcgagattcttaatgacctgcctagtaaagaatatgaaatgttagcaagtgatgtaatctcccaagcatgtgcgaaggataaatacagtgagccagattttcaggttcaaacctgaaattagaaccacctttaggaacactagaaatcatctttcctttcacaaggaaaaatatgaacaggtcctttcccttcagctattgtcttgagttagaaggaattgctggtagagcatagccttgctttttggagtagagattattagagtcttaggtttcccctccttgctttcttctggtgttaggggtattgcactgtcagtaacattgcaatggattattattttttttccaggatcaaactttggtattaaatcatgcttaaagatggaggtaactgtgagcagcaagaatggtgagattgggtgattgtgcaattgtgccagcacacgcctagaactggcaacttactaaagatcagagctgaacttggagaggtggcatgtgggtaccaaacaaatccggttgcagctcttgaagtcactcagcagttagttattgagaacttgcttgtgcagagcatcaaaccaggcacatgatgggggtggaatggcccaagccctccccagctggagagacaagaccattctatgatatggttatgtttaattaattgctaaattgcatggttcaaactaagggctatagaggtttggccaagagggctgggctgatcaaagaagaataagactctaagactgggacctgaagggtaggtggattttagctggttagaagatgttctggctattggtgctgtaaaggatggtggaagaaaagcctgttccatgtaagcagaaacatggcccccttatcctctgatgcaacccagctcaggcccaaggactggcgacctcagtagtcctcactgtaagcaaacgcaaagctcacatcttgagatggaagggacattgcaaaaggagagggccccaaggagatggtgttaatgaggattccctggtatctatttccattatgagggaagagacattggaaaatctgtcaaagtcaaaaattcataagtatatttaaagatttaagcctgaaatggaatatcttaggcagtcatttgaattctctctctatatatgtggtggctgatatttaaaaggcacacaaaacattaaaaaattactttgggaatagcatacccttccctgaataataaagaggtaatatcagggaatagagtagtgtcaggatgtaatcagttctcacctgacaaatgatggccagggccagggttattcatctttgctggtgatatatgaagccgatccagggttctcagagttggacagaaggggttgtttggcaggtggtgtgagggtcctgaagttggctggatcttggtagttgtgttcattttgtaggtgtgtatatgtgtgggggtcatgatgatagtgaagaggacctgtaccatgctttacaaaatgcaacaagattgacttggtacacagaggtagaagcttggatgccagctggccatggtatagagctactgtagtgttgtgtcatgtcatgttgcacatggcatgcttggcccacctgagaaaactgccaggaagctgttgaaagtttcttggcctatggctgggtgtggtggttcatgcctataattccagcactttgggaggctgaggtgggcagattacttgacatcaggagttcaagaccagcctagccaacatggtgaaacccatctctactaaaaatatgaaaattagttggccatggtggcatatgcctgtaatcccagctactcgggaggctgaggcaggagaattgccttgaactggggaggcagaggttgcagtgagccaagatcgcaccaccgcactccagcctgggcgacagagctagactcagtctcacaaaaaaaaaaaagaaagaaagaaagaaagtttcctggccatattgtgttgtgtagcgtagtggctggcccacctgagaaaactgccaggaagctgttgagaggtccctgcccttccctgtaggaagaaacaagaatggatttggcttaattactgcagacatgtgtcttatagccccttgctaccacaagtgtagtccatagacctgcagcattggcattttctaggggtttggtagaaattctgattgttgggtcccatcccagttgctgaatcagaatcagcattttcagaggagacctgagggaggggagcagaggagccatcttgatgtctgtggaggtaacagcacacacaaagccttgaggcagaagcttgctggtgactttgcaattgggtgagaaggtcattgtggtgagatggggaagcaaggtactacttcaaaggctgggtcatgggtgacctcaaaggctctggtcaggactttgggttttattgtatattagaggggaagccattgaaaggctttgacataatttgacttgattttagactcctactgatcactctggttggtggatcagagtgtgattgccatgggggtagtgggacatggtcacattctggatgttttagaagaaagagttgaaaggattggctgactggaaataccatgtaagagacagagatgaacaacaggaagagtggaggtgccatttactggcaaggaggggcagatttggggctgagaattaggttctggacatattaaactggagatgcttatcagccatccaaatggagatgtcaagaaggtaactgaattgagaggacccctgtggggaggggtcaggactggagctagaaacttgggagtttctgtcagtatgtaggtgatatttaaagtcatgaggctgaatgagatcacttcattccccaccagatacatgtagggaattagcgtgacagtgatgatcaatgggttttggtgatcatggtggtattgctggaacttaatcagctctaatgtcctctgattccatatagtgcgcttgctcgttatattccttgtctattctcattttgaatgtaattttaatattcatcaattgcagcaaaaggaagaaaatatgttattaactggacccttcagcttctgcctgtctatgccaactccagtgcacactagggaaacctggactccacactgactgggatgtccctgtcaccttgaattggctcagcccagggagctctgggtggcagggccctgaaatcctgccctattgcagcacaaagcaggatggatgagatattccaactcactacttacaggtgttctttaagggagcgcttaggaagttttactcagtttaacttaagacataagtaataccattcccaattcagggcaatggcttagaacctgactcaatgtcctttttactaagtaattatccagatttccttgctaaatgttattttatatattatgtttaatagcctctttcttttggctatggaaggatggtaatagcagccgataatgtatcacatactcatctcaaagttctgcctctggcacctgtggctggagtagagggaagcttgtggtcaggcctcagacaaattccatgtccctactcactggtcctgggttggttcacttctcaggggcctaaggaatcacagataactttttaacctttaaaacattcctcatttttaaagatttgggtaaacctatagagctcatctggccaaactgctcctttgcctcaattcagagcccccatgggacaactgtgggtaatagaaagccctagtagagaggaactgagcagcatagacttttgggcaatggttagatgtcataaatgcatgataaaaattaagccaccactgcatctcaagatagccaattccttttagtaccctgaggctggctttcagtaaaggttcactgggttggactcgtgtgataggaattaggttactgtgttgtttgtacagcgtgtgtttggtagcatgcacatgggcttcttagtgacgacctggtgatgcaaacagtcttccagtagctactggacacctactgtttgccagttgaccccctaaagagttactgagggctcagtgggtgctaggcatatagatgacaccaaaatatttgtcattgatctccatctgccctgaaattatgttctccagatagtcaaggctaaaacccacatcaaaaatatgtatgaaaacctaagagagcagggaatgacattggccattgtatttataaacaggttagacgtatttcctgccctcagagactttccagtctagaagggaagcagagtatatttgcatgaaatgccaaataacagaataatgcttagtattagtttgaaagcggaagtggcagagcttccaggaatcctgaggatgtgtgaaccttttggctacatctcagaatcacctggtgaactgttgaaaactgagatgcctgtgcccagccccagactcattgggcatctgtgtgttgaaaagttccctgggctgggcatagtggctcacacctgtaatcccagcactttgggaggccgaggcgggtggaccttgaggtcaggtgttcaagaccagcctggccacgatggggaaaccccatctctactaaaaatacaaaaattagctgggcgtggtggcatgtgcctgtaatcccagctactcaggaggctgaggcagagagttgcttgaacctaggaggtggaggtggcagtcagccgagatcacaccactgcactccagcctgggtgacagactgactccgtctcacaaaaaaaaaaaaacaaaaaaaaaagaaagaaaagttctctgggtgattctttgtttttttctttttagaacctgataatacttgattttttaattttgttttttatttttccataagttattgggggtacaggtggtatttggttatatgagtcagttctttagtggtgatttgtgagattttggtgcacccatcacctgagcagtatacactgcatcctattgtagtcttttatccctcgtccccctcccactcttccccccaagtccccaaattccattgtatcattcttatgcctttgtgtcatcatagcttagctcccacatatcagtgagaacatacgatgtctggttttcagttcctgagttgcttcactcagaataatagtctccaatctcatccaggtctctgcaaatgccgttaattccttcctttttatggctgattagtattccactgtatacatataccacagtttctttattcacttgttgattgttgggcatttaggttggttccatgattttgcaattgtgaattgtgctgctataaacatgtgtgtgcaagtatcattttcatataatgacttcttttcctctgggtagacacccaatagtgggagaaccaaaagtagatctacccccagtgattctgatacataatgaagctcaagaaccactgctttggaaggatagttggtgtgtgggtgcatgtatggagatgggcattgtagcctggcatgagaaagatgtgagaatgccataagatggggagcactgcaagactgcttggtaccatgcccctttgctgactacacaccagagacaaccagaagatctaagcgtttcagaggcaagaggcaatgaagaggagaaaaccacaattaaaagaaaaaacaacttttagatcatcagtaaacaactgagtgtgctaagtactagtctaagtgttttgtacttacataatcatcatcataaacccacaagttaggtaatactgttttccttactttcagatgagaaactggttaagtaaattaccccaaatcatgtggtttcctggcctggagggtaggatttgtttggatgaaaagtggaaatccagtgggaaagggacagctttcagaagaacttgaagtcctggagaagagattgaattttatcctgaaagccacagggaaatcctgtggttaccaccatcctttatgtgaccttactctcaatagtgagtgtttggactttattcattggatgatgggcagcttttgagccaacaaacaacatggggaaagtggtgttttaaggtgaatctgtcaggtgctgtgtagattcaagtggagggtacctagaaacagattagctaaaactaaaaccatttcctaaaacaccacaaacaacaaaagtgaatattgattgagccctcactatatgccatgtgctgtcctttacatctatcatcttcacaaaaaccctgtgaagtacatactcatcatgtacccattttacaggttaggaaaccaaggtacagagaagtaacttgctgaaggtcacacagctggctagtgtccaagtcaggattcaaattgtgttgcttgattccagaatctaggttactgtctactctgttataggctcttatatctcctaggactttggcagtgataagtggaagtggaaatagagatacatgacataaagagtaaatgtcaggtattacatgatgctggaatagtgtgagcatgcttaggaaatccccagcagggaagagttccttgcacaaagaaattgagtagggtttagaacagcacgtgaaggaaggcagaaggcctttctgaaataagcgggtttatgtttagaacatgggagaagagatagcataggaaattgccattctgatggccctgcatgtactctgataaaaaccatggaagttgtatgagaaatgagtatggtgaagtgagtagatttgttggttttggaatcagacagatgtggttgtgggttccagtccttttcttactaacctgtgacctagggcagtttgcataatctctgcatttcagttttcccatgtgtatattgaggataatagaagcatcatccttattaagatatcataaagattgagttcatgtatggaaaggagatgaaaaatatgacatattccatcaataccagctattactgttatgcttctcgttattacagtcattcatgggtgttaaaacagaataatgagatctctattttggagagagtactttggtgttagtgggtgcaacacaaactcaagagcttctaggtttccagttctggctccacctgctagctatatgatttggggtaattcacttaaccaatttctcatctgaaagcaaggaaaacagtattacctaacttgtgggttgatgatgatgattatgtaaatatgaaacacttagaatagcacttagcacactcagttgtttattgatgatccaaaagttgttgttttttcttttaattgtgattttctcctcttcattgcctcttgcctctgaaacatttagacctcttgttgtccctggtgtgtcacaggggcctgtggcctgtggcctgtggtgttgcccttgctgaatcctatttaactgttgagaatgtgtctgggtaagtagtcattgctgcctcaaaacatagattcatgagcaaagtgactatgaagatttgatgtgatatgtgggtgatgatcacacataaagggcacagcacataggttacaggaatttcgctgggctgtgaatttctgacatcagcctcctcgtttaatatttatccgccccacttctctcttacttgggacctgtactgaggcatggaccttgttccacaagggactgagagataacagtgctaactctgagagtgtgcatttgtgtgtgtgtgtgtgtgtgtgtgtgtgtgtaagagaatattagtagcctaaagggagatctcatgctgctttgctttgtttcatttttttggttgtaaagttgaataaaaggcacttagtccaaaacttcaaaaaaattgctactgggcaaagtaattttgtgtcaggcttctgttcagggcagatttacactggttataaatctctgaaattaaggtcttaccgtagaaaagctgaaatgtattcaacattagcagacacccagccctgttctgaaccagtggccattcttccgccatgtataatagcaatatctatctatgtgtttgggggcaataataagtttaaatatgcctcttagaatgggtaatggctctccaatgagtagcagaattttctatcaacaattcttttcctagaaccaaaggttaagttcaagagtttgatttaatgacaaagttaattaggcccttaacattacaggtttcttgcctttcattttctaatcaagatcatagtctaaggtcagcaaccttgcagaagtggggaacacaaggccagcacttgttcttctgatgtttggggagggtgactgtaggagatgaggagtgcttagcaatcactgagttgacaaagggcctggagaatgcctgctagacctgaagaatttcattcttacctctaccgaaccttagatataaaatatgcttgagctttaaggaaacttaaggattatctaatcagtcctttcattttacagccagggaaactgaggctaaagggactaagaaatttctcagtggttacatagttcacttgaggcagagtaatggatctcctaagattaaaccacctacttctaatcaaaatgatctatcctcaaatactcatattcaaggaaaagcaaaacctcttcttggcttataggatttatgttgtttatgagctagttttgctaaagcacttcttcctgcctttttttttttttttttttttttgagacggagtctcacgttgttgcccaggctgtagtgcagtggcacaatctcggctcactgcaacctccacctcccaggttcaagcagttctctgccccagtctcctgagtagctgggattacaggcacccaccaccacgcctggctaatttttttttgtatttttagtagagacggggtttcaccatgtgggccaggctggtcttgaactcctgacctcatgatccatctgccttggcctcccaaagtgctgggattacaggcgtgagccactgcgcctggccttcctactactttttaaagcaaatatattccatttgatcttggaccatgataaaccagtaaagactattggtttgaaacaaagaaattgcctgttgctacttagtccaagaatttaaaaaataataaaaaaagaaggaatccattagaagaaccttagggattctcataactggtcagagattgaaggacctggtaagggaaagggaaagatatcaaagcaggtccagaagttctagaaagaggacacaagacagatttctggaggcagaaacttccgtcccagcatttgacactgctgtatcataaatgaatcctcaccagctctctgtcttcatctcacttgttcctgatgcaaagtccaggtgaggaaatttaaagaattgagccaagggatttgccagtgctttgcctgccgggaaagcagggagaggagaggtatggatgctctagcttctactggaccctgggaacgggcactgcccactgaaaaaaaaaacacacattttggggaatttctcaaaacaagaaaaaaaaagagtccaggttttagattgtcccaaactcaagaaatgtctaagataaaagactttatgggtcattctgaagcttgaccttgctgtatgggaaaatatagtccaaggtacagactaattcatagataactttgggattcaatttacttctgggctcggctattcatgttttaatcttaaataggagtctgctggttcagggccttaaactttaagtgaaagttttgtggtgggatttttggactataatataggtgaccagatttggaaatacccttgaaaatgacgacatttcagaaatagtaaaaccatccatgtgtgtatctttccacacaggtacatgctctatacctggccctatgctgtgcattggttaccaagaagcagacaaaatgttgtgcccttctgcagcctgggcattagtcaggttcatatatagggtgctttgacttctcgcttatagtaaaatattcaaatgcagagaagactattgaagaaggcaagatttttggttacacgccagtacttcaaaagctccaaccctctcaaaaattattagtgtttgcttttccagaagagctgtttctaccaaacttggttcagaatcttcagcaaacatttcttaccagatgcgatgctagaataagtctagccatgaagaaccttataatccagtagaggagacagacatggaaatgaatcatttctatgaaatgcgttaagttctgagacagagatgtgcccagtgtgctacgtaaagacaaagactcacattcttcagatgcgctagcataggaaagttttcctgtagtttgtcttaatcctagaggtacaatgtaaatgcatcttctctgttcacctgtgtggtcagtcatggacagttactgggtggctgttacatgcaaggccagaatgcggggcctgtgatctagcagctaagggcatccattcagctaaagatgtcttcctttctccctttcctttccaaaaatggccaactacaacctcttagatttggggctggagtaggtgggggactgatgaagcatccattcatggctttggtacaggattcgcctaaatctggacatatccccaaagtactagttctgcagggatgaggacagagcccaggagaactgtctttggtttcaccttcctctccaatgtgttcaactcccttgcaggaatgttcttgggggagcactctgcaaatccacatcaggcccagaagagaaatgtttctttgaagacctgtctctattaatttgcatagatatttgtgtatgattttatttacattggtgaggcagaacagtagttctccagctttgatgtgtgtgagccttggagattagagctggggctcttcctttgagaaaacaaatacttttgtgttgatttctatgagatataaatcatacccaggaagtttacagttgagtaagaatggtataattactgattgtataccagaagcggacatatttatgaaaagacttgaaaaagcttgtaatcccttcccgtattttgaataactaattgctatgtcatcctggcatatttgcaccacaagagttaagtctgtcaaatgtttccctctgaaaaccttgttttaagggatttctaacttggtcgtaaaactgtgctccaagttggagctgacttgatgggagtctgtgcttggaaggcttgatttgaatggtgccagtcagagttaaattacaggctgggaaaaaggaaacaaaatttttaaaaaggaggtgtttatggttcccggttcccctaagtacttcttgaggatcaaaatagcctctttaaaataaattgcagaccattagtacatgatggaggaaacccctttgagactagattgggggaggggaaggcaagggcacaagaaaaaagagattgatttgggccactttcagcctgtgcagtgcattgccccccagcccccgcagcatgcccctggaggggttaatgcacacagatggcctttcatgtacccacagttgccatttctgtcagtctaagtggacctcactgcagatccactccaattctgaatcttgattggaatttgggtttcttggaatgtgttcttcctccatgcccacccccccacctttctttttctttttaaacaaatagaacactattgcctgccatcttatgcccttatggatcataaagtcttactgcataggaccttgagtatatcctgtctacgctgaactagagatagctgctggataatcatatttgcagagatttcttcatacttgatgccagacattcaagccaaaaaggtagtccttggctgggagtatttatttgatcccctacgtagagccagcttaggtatctctcccatccatcaacaacagacaattcaagataatgagaaagagagagagggagacagagagggaaagggagatgcaagaggaggaggagaggaggaagaagaggaagagagattgtttctatctctgtgtgagtcaccttgaactccagtggtctgggagtagcctctgtgctctagcacttaccatcaatggaagtgggacagatttatggcctggcatgttcaacctgaattcaaatctccttgtctttttaagatttcactcatgccttaatgacacctttttttttttttaagaaagctaattgcattggtttctccaagaggcatcactttgaacaatccatcctgactgtgaaaacaaatatatgcttgacttatttcatttattttctcccaaaacctaaatgaggataaagccattctggataagaagacatgtgtgtgtctttgtcacatcttttatcatcatgactgcttttccaaataatacaacttgtgacaaatgcgaacattaattacagttaacaaagaaatgtcatgtgaagtattcatggggggagaaaaaagaaccgagacaatcaatgagattacatcttgcaccaagcttcaagtcaaagtgcaaaagtcagaaatcaaataccatcagttatcaaattatgttaatgattctaatgaaagcttctggtattttgttcaagagtgtgttgctgtaatggtaactaatagaacaagagaagctgattgccgcgaattaattagaactgactgctggagtttcctttttatttatttatttaaatattgacaacctgttttagatctcgaggtttttcacgtggtctttttcttcgctccccaagtcatcaacctgccaaggagtgagaatgtaattgtgttttctcatactgtggatatctctcaccagcctcagggttttgacccagactgacagcagacaaattaaactgaagtacccctaacatttggggggttcagtatgagagtccagatgaggccccttgctcaatgctcccttctcttttccttcagccccacattccccccacaagaggcctttgcacacatccacatgggcacccagcttgcccatccaaggtctacccaccaatggctgctctttggctaccccttggccttaggggtgcatgcccgtggcaccatgcactattgagagataggacccagggaagaggtcattgcaggcgctagaaatgcttagggttgtttgagaagtgaattttgggttccgggtaatcataacatggtctactaactggggagtaggctccaggttggaaatgcccttgttccctggacctctttatcccataggggtgggaggggatggaggagggccagagtgggccttctaaagtgcttggccttgggcagggggctctagttacttggatctaaaagcagtaccggacatgcatattctttgctttggggtatctagagctctctcactaaaatctattttattctttctgtttttgtttgtttattcattccttcatttattcaacactcacttggcactgactgtgccaagctctaggacacaggaaaataaggtctctcccttcagggatctcacgggcttttcaaatttgtaatgcattaataaatactagatagagatctgttcaaagttctttgccttccagatctgccttgtattctgtcctctgagtgctgttcttttcttctttatcatggcagcaggtgttacagatcctgtggcagtgaggagggccaacccagggcttagaagaggggactgactctggttcccccgacaaccccccgtgctgctcctttagggctccccaggggcccttcagagctcccaccctctggccagagaaatgtccccactgaatccagatcagaagcagataaatggagagtctggcagggggcatcagtcccacagagaatcttctacagctatagtgaaaacgcccagtctaggaggggccgttctgactgatgactccaggcagcctgaaccaggatccttttgtggagcttctgcctagaaagtgaattgtgttaaaatcaacgtatcttgctctcatattaaaatccctctctctatttaagtcattgagggaatttcctaaattttccaccatggagggaaggttttggttataataccaaatggatattgacagggccttgctcttagaaaactaatcatgacatctgggtaactgagcacaggtcagctctgaagccctccctcctgggtgtcgggaagcacatcagactgtgttgaatttccttcgctggctaaattggtacattagggcaaaaacgatgtccacatttgcatagttgatttcattactattgccattattgatgcctagctcctctgaaagaaaggagccataaaagcaaataaaatcacttcgcgattccattattggataaattaccacattactgcctgcgttttagggctaaagccattccccgcatttgcatagtttatttcattatcattattaataacaacaacaataataatgatgatgactaggatccttgaatgaaaggaactagaaaaatgccagagcctcgagaagtctttatggactcagtgcgatcactaggagtccctttatctgctgctgaaatgcagccactccgttgcattgcaccaaccaaaagcttttaacagagctcccgttaaagcagttcagaacatgtggggccgggtgcctggtttgagatagtgactagttacttgtgcctactaaagatttaggttgggagtccctgcttagcccctaactagttctgtctcttcagggatgttgcttaaattctccaaacttcagcttcttcgcaaatgaaatggggattatgacacttgctctgctgtgtgatgaaaagcaaaagaaatggtgaatgtgaacatgttctatagaccataaaactacccatagattcaagagactaatactaccgtattgaaccttggaatgacggctgtggctgggatgctgtacagtggaggcagtggctagactgtgtctctttggctgggagaattttctaaaaaactaccataggtttctaaggcatcatcctctatgataagtagggagagcatacctgtgtatatttaccaatcttggatatttacaaatagcttactttgatagccagcatttctgggatgagctggtggccctgatagtgttctttcttactcagcaacttctaattatgccttgcttttctccttggtcatagaggcaagaagtataaagtctttttgtctattaattctgaggtcctgtagtgaaagcaaggtccactggtggccgtctatggtttgctggagaattttccccctggttttgtttttattattttattttatttctgctgtaccaggggctccaaaaaaatgaatgtgtcagtaaaggatttgacagtatgttacgacagtcatcaatccactgagccctgtagccataaataagcttcattcgctgccacactaaagaggacagtttttcttctccaggacattgaaaatgtcacagcgagggaattgtttgtccctgtctccacggcaacgccaccagcacttatcattaactttcacaccaagattttaatcagcgctctttgcggcctgagaccaagtcaacatcagcccaaattttcaaagccgttattctaattatgacgagaaagctatagattgatgagccgagttttctgcaaggactggtggcagttaattctcgtgacctgtgtggctcggggagtctctcttagagatggagtcttgaaagttcgattattagtgacagcttgtaagtgagaggagccttatctctccagagagtgttgataacttgagacaaggtttaactaggaagtagtgagacagtggaaggaggggagagagggggagaaagggaaaaaaaagtgcacactctatctgcagcgtgcatccagtgtaatgagaaaatatggacaggcacaatttcacaagttgtaaattctggtagccttcagttgtaaattctggtggaggctgttttactcggctatctgataatgtgtgaaaatatttgtccctttgcttcacaggcatgggcaagcactattttccagaaaatgcattaaacttcccagctctctcctgcctctttttttttttttttttttaaatcatagaccctctaaaaacaaaatgagaatttgtgattgaaatgaaatggtaactgatttttttttaaaaagattctccctaaatcagacctagtgtttgacagaacagtagaatgactatagtttacagtaatctattgtatgttttgaaatagctaaaaaagaataattcaaatgcttctagcataaagaaaagataaatatttaaagtgatgaatatcccaattacatcaatttgatctttaaaaattatatgaatgtatgaaattatcacatgtataccaaaaaaaaaaagagtctgtcaaaatgttaaaaaagactcttccttctcatttccctcagctgcctcccacccccagccttttttgagtcagtctaatttctagagatttggggtttgcaatgaaggggagtagcatggtgctaaccactctgtcccttcctgtttctgttggtctctcgtgttctctgctttcgttaacctggctgatgtatgtccctatgttcttggccatgcatagacaatgttcatgctgttgccatcgtcatgccttcaaacttgctcttgggaagtgggacatttccctctctctgtctaaggcattcagccgagccattagtctgctggggaggaggtgggagtgatggtcactgagtccccctagccaaaggttttttttttcttttttttaaaaatgatctcattatttgttctctagtctcttcctaagggagggtgcagaaaggtagcatggtgaggtcagaagaacctcatcctagatgctcccagtcccagctctcaccccagctccacccctgccacagaggaagactctcccctgcctctgttttctcatctttcaaatggtgatcatagtatctgtccagcctccttcacttatcaaatgagaatataggaatgaaattgctcatacttcatgtgatcattgcattaaagattatggtgcatgtgtgagcactgttggttgtcagcttttttagtttatcttcttttccagaactagaaaaatgatgatgcagttacattttatagtgttttctttttcaaattattttcacatgtttaaaaccagcaccattatctccattagctttattttgcccctgagaacactgaggcacagaaaggtgaggtatcttgcttgtggtcacacagccaattagaggtctaaccaggtatagagctaactgtggcctccgattcccagcttgcacttccctagtctcatgctgcttaccatattaataggctgggattaacgaaaaaagcaaacccaattagtttctgttgcagctcttttacaatcctgtcttgtttccctgtgtgtttatatgtatgttttaatagcattccctgccttttatgctgaggttgctcgaggtatgtttataatggtggcgtaattataataataaaatacaaatccatccacggagtgcgctcattactggctggccaggtaaaacaaacaggcctggcattgatgccgaaacaaggcagtttatttctaatgtggtgcctctttgaaacacaagatgctttacttctctagcaaaggaggccctgtcctctgaacataagtggacttgggggtgcaaggttgaacaggtaattgagacaccggggctaggttgctttaacatggtctggccttttcaatctctctttttccaggggagagttgaaaaccaagaggggaaattgttccctctgattctctgtagctgtaagatctttcctggaatatacaagtaggccctttggcattcaaactcttggacgtaggagtttctaatgtatacgaaagggaaaattattgttgtgaaaagagtcataggagagagagaatgtgtgtgtttttttaaatgcctgtctgtccttgttaattagaagtgcacatattgggaaattaactatgaaatactaaaaatgataaattattccttatttgaaagtataaattaaaggtttagtgtatataaaatttgtcatgtttaattgcaagttcaattaaaattcagggtaatgatgatttatacaggtttctgtgtaatttgatattcattagcttagccagacacatgctgatattagctcgttaattatgtttccttttgttgaaggcagccttgtgaaagcaatctgctcaaagttttctaaactcattctgctaaatgaatatttggcagctgttcatgttattgagatggtcactgtggcttcatttcactcattggccgcatcaatcataccttctctgtgacaaacaagggtttctcattacaaacccatttatgaaggttatggctgacattaaagagtgatggcatggtacgctgctgttactttacagtagcgttagagtggagctgtcgttaatatccacacctcccatgtggtcaacctgtttaaaatacgtaggaagggagggcgaaatcatcacagtggccctggtgccatttccaacaccatcggctcaaacttgggaatcaaaacttgcgtctcagaaggaggactattaagggagcagtgtctcagctccccactgtaggcttcccagggcttgccatacccagttcataggagtagatgttgaggtccagaaaagttaagggattcactcacggtggcatggtggctctgagcatgactcttgggcaggtgaaggggaaagcccaggttgcctgatgaagacgctccctgaagcctgtcatccatggtggtgatgagttggaggaatcaccatctgcctggggaaacagctgtgtaacagtcctgtgccctgcatttttggaggattataaatatttttacagattttccatagcctttattgtagggtcctcatactttacttgggatattgtggaaaggaaggtgctgtctttccaaaaggaaagctttgacaagtaggaaagctgaggcgcagagaagttttttgatttgtccaaagtcactgatgcagatactgactggccagagccagggccctgggcttctctgcacatcatgtgctacagttgtcttccctccaccagcaccttcttgcaggatggaactagacacttggtaaatggtaaaaatgtctctaggctgacccatatattagcttctactcatttgtatagtaataaattggcagtctggtttgtgatggcaaaatgcaatggaaatttcttacaagaagttatcatgtagtatgtctatagttaaatttacatacttgtgcattttttgggaggaagggtttagggactcatatacacatttctttttttctttgagagctgagtcttatgcattgggtctcctttgtaggctgatgtttcttttgaggtcgttgtgaaagagatggctggctagctctccatcgatgtcatcctcttcttccacagtggagcgttgttgctgggactacatcttccacctcctatccccatcttgctccacgtgggatcatgcgatttttgtacccacaggctctacacgcgctctttccccatctgccagttagaggtgaaggactcagaggcataggcaatggcagagtcaaacaaaatagaaggagcctgggcccctgaatcactgtgtggaaagccatgtactgaacatcaagtactgaatatctgattggacttcttatgagcatgacataaacatctattatgtttaaagtccctaaaatttcaggatttatctatcacagcatctagtattaccttaactagtaactaactccttcattcattctacaaatatttgttaaatattttgctctgggccaaatcttgggctaagggttgaggacataaggataaaaaagataaaaagatgctatttctgaccttggggaatgcaatcacatagtaagggagctatacaagtgaaaatattttaccctagtatagtaagtgctgtaaaatgtgtttaagggaggagaacccaaagaagtaatttttttgaaatatctagtgaaatagcagatttaaacttttatatttcagtaggaccttttatttggaatgaaatcatatgtgggatccttcagttcatacaacagaaaaaatctgaagggcctttagtagaaacaggagcctctaggctcatggaacctctctctgcatcctcttggcctgctctgatgtccctgcagccctggatgctgtggcgtatcctctgaaaacccacagagacagattcaagcccaaagatagactgttcttgcactgatgtatttttttttttattctgtaagttgtggtacatggtagctctgttttatagaatgcttatctctaataggtggaagttgagctggtggtaggtgaatagtttattccagaacttttatttggacacattatctatttgacctcgggtaggcttttaaactttttgcctcaatttcttcatatgtaaaacagcgataataatagtgcctatatcctagaatgattatgagaattaaacaagttaatatacataaaggactgtcataagcatgtcatttagtgaatggtcaacagtgttgggtctctgaaacccatgtgttacaaacatatcacatcatatttgtgagtacttctaaattttgatggagtaagcaaaagaatgctggaaacgacttcaatgtgtagggaatgatatcttagtaacaagattctgaaacctccggtagctaatctgtgatttccttttgcttctatgcaccactcaagttcttcttatggttttctgaaacttaggagggactggaatttttcttcatcgtgtttatagagaaatgtatcataggagaaacttgagttgggttttatttctttgacattgatgtttttcatttcacctccactcctttggagacctagacaatgtaacttagaactttttattttctaatttcgccactttatgtcttattaatgcattttgtcagtgtggaaagccctctggtggtcaaagtaattcctatgtggctcttttagatgagttggaataacatcaagttgatgttcaagagctgggttcaaattctatttttctcctttgctcatttctttttctagttaaactataaagtaaattttctattaaacaggtcttctgcagcattttagttctaaaaatgtctagggaaaaatagtggtaggacagttagctttactcaggttaaaatttattagtgatagtattaacattttggagggtttaaatgctgtgccgtccagtattttgctgtcactctaggaatgaaatgtaacatacactctgggttgaagatccttaggactctatgtaatgtaaaggctggaagtgggggacttagaatttatcgtctcatcttctagaaagagaaattggagcaagtgatttgctcaagatgtcagctgggagcaaagccatgcatagaaggcaggtcttctgtgtgtgattcctgtgctcttttagccatgttgcttgaggaatatcatagccaggccaagttcatcaatccctggtctctctaccagataccgaggtggccaggtctcatcaaactcagccataggatacttctgtccaggcaaaattcaactcatatgctttccatgggttctctgtctcttgtttggtgcgagacagggtgcaggattttctttttgtggtttagtgttgggagttgattggttgcgtcaatggagtaatctggcatgaacaatcaccctcagcatatcctcactattaaacagcattttttttttggagaggatgtgcattattctttactgtgtgctggccactgcaactcatcataaagatgaatgactgacaggtgacctatgtctggtgtcctaggagagtagataccttggagatgaagaaacatctgttccactctgacattggcaagaaaagctggcttgtccctccctttcctggtgctattgcatgggcttatattattattattattatttgagtctttggctatgtctaatgtaggctgggccccgaggctatttcttggtgcaccctgtgtgacatggtacaatcacaagaaagctgggaggtggcatggggggagcacagaagatcccctaatgtattctcaatcccagttcctgggcacagacagtgctacctgagagactgaggagctaggggctccagaaaggtagaaattcaggttaattacccagaatcttgtagtgttcctgggtcgttctctggatgtaggtacattttctcaagagactgtttaactctttacatctttgttactgtcctcattgctaaacttcacaagagcaggtaatgctggcgtttatgaaagagtgaacagctaataagataggaattcaattcacatggcttggtctgattcaggagttggggtagtaagttaaatcactcactgttcttcagtgagcatgtatgatttgagtccttatgctgtggctatctactgtgtcagatagaaaataaaatgtagcccctgccttcaaagagcttaaaagtgatttcattttgtgagcacttcctgagtgcctgccacatgcccaggatcctgctgggtgcttgaggctgaataagtccatgctgtcttcagcagaagttgtcggtgaccacctatgccctgtcagtattaccctttctgtgtacattgcccagccagcagcacctgcagctttgccttagagttttctctggtgactgaaccacttttgcttgggacagggaaggtgataaggccagagaagcaggagttggtggattaaaaactctgttatttttcatgggggtgactttgaggcacagtcttttctgtctcccagagctccccagctgcatgaactccagctggacacagtgggaacttgctcaacaatacaccatgcaccattactcatttcccccccttccctttctcatgtccccactctcccactcctagggtcacctccccaaaaatgctttcacctaaatccttcttccatcatctgtttctgaagaaaccagactataatatcttccatgctcttcacatgcctttgattgaagtaaatttctgatgaatgttgcagaggacatgcaaagtgctgaggtaaagaagagaatgggtgacagaatccaaatagaaggatcttggaagccctcttggaagaggttgcatctgaattagaattgtaggggttgggttgggctttgttaggaagttatggaaaggaagggcattccaggctgagagaacagcttctgcaaagacctggaggtgggaggaatatgaggcatatttgcaaaatggtaaatgtctgatatgtctgtagttcagggtacattagggtgggataggggaggtgaggatgagggaatgtaggaagaagaatgtaaggactgtaggtagagttctacttattgatggtttgaatgtgaggctgagacatgtagccttgcctttgtgggcagtggtgggctctcaaggtatcttagcaatggggtagtatgtgtcttttaggatgaagaagcaggaataatatatacacaaaatagaaacatgtcaagtgtgaggctattgcttatcctctaattgctggggaatttcaaactgaggagagacaagtgtgagtattcagagcagccagggagggatcaagtgagaggtagaagttgagtctagtgaatgaatagacggtagttaagagaaggttgaagccaggcatccaggacagaatgtgcaaaggctcagggacaggaataatctagctttagagatgcatcatgactttcatagacgctaggtacatgggcctttctgggtcccttcccacctaaaaaactgctagtagttttttttcttaatgattagattgataaagacaaacatgtataataatattatatattaaaacattttctggctgggtacagtggctcaggcctgtaatcccagcactttgggaggccaaggctggtggatcatgaggtcaggagttggagactagcctggccaatatggtgaaaccccgtctctactaaaaagacaaaaattagtcatgcatggtggcgcgagcctgtagtcccagctacccggggggctgaggcaggagaatcgcttgaaccaagaggcagaggttgcagtgagccaagatcgcgccactgcactccagcctggacgacacagcgagactccgtcttggggggaaaaaaaattcttctgcctgaagttaatttttcttttgactttaaacgaaatgaaaacatttttgtagtctctaaagtctcataggtcatgcgccccgtgtgcctgatagagaagtgagccctgccttttgggagccggatgaatcttcatacctccttgaggctaggctgaggtttccctcacctcttttcgtagagctgcagctttggcattaggagggagccttgggctcacctgccaggccctgagtgagaagctcgagggcacaatgtggggtggccttttaggtatacctggtggccggcatcagggtgcccctggagaggagcaaggggacaggagaacgtcctggagcccctgaaattgggtccggctttctatctgtctaggccacctgagcaggctcccatttgcttattttcccgtatgaatcccttgtgagcttatcctccaaaaggcttgccccgccgtgggggtaagtgaaagcttctctgcctgctgcagcatcaccctccttgagcgtttccactgtcagtgttgctagagaagcaccctcctgtccttctgtgtttcctcggaaatgcttacaaagaagcagaggtttacgaaatgaagtgatatcatccgaaaaaagcctgcgaaaagcaaccatggtgagaagactgcgcaaggatttttttttcctccttcttctcaaaaatagtcaaaacacatgcaacgcatacttgtaaaaggatcaaaaaaggagagaaaattgtagctggcagttgttttccccactgttatttggttgctccttagcttccagctgttgaaatggctagtttatgttaatgggtattttgcctctcctattcgtgttactttactccaaatttaaaaatgaacctgtgactttatttatcccatgtgctgggaaaacagagatgcagccttttctgtctatatgatttgcattgtaaggatgcacttacactgccatataagtacataaaattttcatttttgtgagcagggacatattttgagcctctttttttccagttctttctccaaagttaagaagcataattcaataagtgaatgctgtctcccaatatcagagacccattttctgctgtgatagaagatctattggttcccttttatggatctgaaattgtgattggcatgtcatggtcaagatatcacctagagtacacatccctcagttaactaacctctctcttatccttcttctcaaatgatctttcttgtaaactgggttgaatcatgtgtatttggtttcttaattatagacaaatttctcactggatgaaaagtctgctaattagtgattttaaatgtcatccagatatattagtagacaggtgttattttagaaatacagggcaacatgacctcttgtgttgtaacctatacaaaggtaaaagtctatatggtgttatttaatgacaaaagaaaaataaaatcctcaaaatacacctccttcccctcatatgcactcactggcccattgaagaaccaggttgttatcttgttatctgactggattaagttactatgtcatgactgactacaaatactatagctttatattataatgtcagagaagtttaaagctgaagaggccttagaaattctcatgtctaaccttctttttttttttttttttttttttttttttgagacagagtattgccctgtcacccaggctgaagtgcagtggcatgatcgtgatctcagcactgcaacctctgtctcccaggttcaagcaattctcctgcctcagcctcctgagtagctgggattataggcacctgccatcatgcccagctaatttttgtatttttagtagacatgaggtttcaccatgttggccaggcttgtcttgaactgctgacctcaggtgatctgcctgtctcggcctcccaaagtgctaggattataggcgtgagccactgtacctggccctaacttttatttatttattaattaaattatttatagagacaaggcctcctgcctcagcctcctagagtgctgggatgataggtatgagccagcaagtctggcctcgtgtctaacctttttaatttaacagttgagagaactgaggttcagagaggttaagtgacttatccagatcacagtttgtaggacgacctaggcttgactccatgtcttcatttcccaagttttgggccctttctaagctctgaactaggctactttatttagattcagggggcagttaccaggtgactgggctaggcagtgtgggtattctggagttgagtgagacatggtccacctaagaggctgtctattcagctagctctgcagggggatagggtcagaatataagtagctagaataccaggccagtgagttggtgtcataaaattggccaccgttcctgtggactgaatacttaatgagggagtggtcctacctcatggtatcagggaaggcaccttagaagagacaatgacatctgaagtgggtttggatgtacagattgggcttttataggtgctagagtaggtcttattgggcccattggtattaattgtgtccaggaagacagagacttgtctagaggttggaagtacctgatgattctcatagtcctgctttgtcaccatcttggctttcagctctggggctgtcaggaatgggcatggccattgccaggcctatgtgtgtgtgtgtgtgtgtgtgtgtgtgtgtgggtgggtgtgcatgtgtgtataccgaccaccatagcccgtgagccttccctgaaggatgctgctcctgcaagcaccaagtaccaaggaggctaagcagtgggtgcaggcaggacatgcagtgcctggcagcagagactgccaggcacacatggctattgctggctgggctcctcagagctctgggcctggcaagagagaggcagcaggggtgaggcagcccctacctggatgggatggctatttcccagcgcctcattccccaggaggtcacctcgtttctagaggtgctgcctcttgccttgcaaacagagtcagacctgccataaggccacaggggacttagaaaaaccgtccccaccccaccagggctgcctggcacataccctctgctctgccatgcttttctgaatctttaaaataagtttttcattaattttagcatacagtgaagggaagtaacctgtggcttataaataatggcaacagctttatggaaacacctaaaaatcaccaggggcacataacaagaaagttctccatctccaggtgcgaaaacacgctggtgattacttgttgagcaagaccctgtcagcttttttattacaatacattattgggtaatagttttaaaattatttatagaaagaaatcgagctgtgccgagaattccatcatttaatatgttgtctgtgaatctcattagcctttttagcctaggggttaggaaggaaaacagagcgttggctgtattttgaagattgagcactatatacactttttgtcgggggcttgttgaccttatgttaagttgcttctttgcgagtctttctgtgttacagctctggtttccatggtatttacataaacctagcaacagtttgctgtgtagaggcagtggcagggcccaccatctcctctgccaagaaggaggagcagcttaggatgcctgctgtgcaggccatcaatgggcaagtctctttcaggtaagttacagaataggtaagaattggggtgagatgggatgtcagctgctccccagtgtatgtgtggcctctcctctgtctccaggtgacagaggcagctccagtattctgtttttgaaacccatccggtgagttctcccatctagccccaggccaagcagcatgggtctcggcagaagctcatcctgggagtgggctgctctagagaacacgactccatgctgtccccaggcctgtgttctccactgaccccacagctgcatggccagtaggccttaggctaagttcaggaaggacccatctgaaatactcctcctaaatgaagagccgttctctggtataagagggatgttagtgtggtcagaacaaggctaaatccggaatcgggagagtgtgacaaatatcaacgaatggattattttcaaatgtgatctctctaatcagctgtgcagggtgataagaaagagcaaggggcttggacactggccccagaatggtgcaatgagttctttatacctcacaacatggcaggaacatttaaaaaacaaggtaaaaggaagtcactgggagcaaacagaagaagtgaagagctgacttagagcacagtgaccttgggcaaataaacttctataagtctcggtttctttctccataaattcagaataatggtacgtaccccgccttggtacttggtgcttgcaggagcagcatcctgcagggaaggctcacaggctgtggtggtcggtgcacacacatgcacacccacacatgcacatgtgcgcacacacacacacacacacacacaggcctggcactggccatgcccattcctgacacccccagagctgaaagccaagatggtgacaaagcaggactatgagaatcatcaggtacttccaagctctagacaacctctgatttctgtgagaacttgatgagatcatggaaattaagcattcagagcagtgtcacggctcactggggtcgagcaagtagaaaatctgggattcaaacccagacagtctagccgtagaacagtggcctttaccactaccctattgtattatgccattctttcattggtataaagaactatttgagactgggtaatttatttttttaaaaagagccttagttggctcacagttctacaggctgtacaggaagcatagcagcatctgcttctggggaggcctcagggagtttccaatcacggtggaaggcaaagagggagcgggcacatcacgtggggaaagcaggagcgagcgagagagaggagcaggaggtgccacaccctttcaaataaccagatctcgcaggaactcactaggacagcaccaaggggatggtgctaaatcattcataagaaatccacccccatgatccaatcacctcccaccagaccccacctttaatattagggattacgatccaacatgagatttagaagggacacatatccaaactatatcaactatgatgcctccaacaccttcagaagcagatgtcttgaactgagccataagcaatgtggagaatcaagccaggtggagaagaggggctttgactttggagcatagagagcatagagtaggtaagtatgaatgtgaggccttcatgggaacctgccccattcttgcctttattcacctgtttagtttaaagacgttgattgggcaccagttatatttcaacccaggcactgtgtgtgaagaaaaaaaaagatggagcagacagttcctcccacaaatagttgggagttaggagagttgtcctgcagagtaaaaagagaaaataacagctttatgagtagttaccatgtgtcaggcgtgattttgtgggctttacgtatcttaaatcattggatcctcacaagggccgtaggaagtaggtgccgttattaatgtctattttagacaggaggacctgaggttctaaagaggcttagtgaattgactgaagtcatagaactgaccggggacaaagccgggatgcgaagctgggcagcctggcctctgattcctggctctgaaatttctctctatggcctgtatgatgctaatcatgggcagctccaaagctgtcggggatgtttagtctaggggttgactaagaaacaggagaatagtgaaggctcaagattcatttactcagctggtctgcaaatttttattcttggcatcatttggaatgtgtttcagcagtgtagatgattttatcttacaggttttattcagctcagtgccatgcaggtgcaattggagcatacagatcctgtgcaccgccactcgttgagctgtgtgtggccaaacacaggtacaggaaagctcagcacctgggcctttagggttttgcctactcagtgttctaagatgtagagatatttctgtaggagggagtgatagtaggtttttggatccaaggaatctcagttagggaggtccttggagctcatctcatgaaaactcaatggcttaccccccgaaaaaggctttctgaaatctttaggcattctgtaaagttgtatctaaggttaagagaattgaaactgcagcttttatggagatgtctgcctggattagatatgtttcctctttctccctgggatgtgccacctggagaaggtccagggagcagccctgtggcttttgagaaatggttcagtttgctctggggccttctgatgcttctctgacacgtccgagtaggcagcatttttttttaaacccttgattttcagaaacgcattgtccctgagttattaataattatctctctctcctctctactctttctttctctcactctgaaaatcaacatcaacttgactaaatcccttgagttgagcttagtccagtttttcagttttcttctgcagctgaacactcaatgcttgattctcctgggggttgggtttagggccctccctatgttcccagtctctaggcctagtaagtacattgttttggaaagcctcttccctttcagtgctggctccctagagaccttcaaaacatcttgggtcagaaagtgcaatccaagcaagcctagatggtacaccacccccacccaaaagatccggatttgagattacccccaggacttttcctgttgatggcacatttgacttacagtatagtaatgtgtagtgctttttctctatgagcacttcataagcatccttcggtgatcatgacttagaaatgattggagaacctgcttgttcagaaggccagatgtttcacaagaaaatgaaggacagaggtctcccagtcagcaatattagtagtcttgggataatagcattggcaggagtctaaaagtttgtctgataccaactccttgctataacttatccaatccagccctctctatgcgctttacagataaggaagccaaagtatatagaggaaaattcccaaggatagtcacatagctgattgttatggcagagctgcgttatccttagcattgtaccacattcctccttcttctctggctctcagattttctagcacaaagagcaaaaacaaaaacaaccccaaagactagaaaatgaaacacagctcagcctgggttttataatgccagtcataggaggtgctcaataaatgcttatgacttgctgcacccccaggaagtactgcctcttctttatgtgcatagcttcgcgcagttgcaggcatgattccagcctctggagatgtctgatagggtgtgcggatgggccatgttgttccactagagtaatttcctagagagaggagagaagggagctctcattttgtatgtggtctgtctaatgcctctcacatccaataactttaaaaccaatcaaattaataatgtagggagaaacaaatggattcactctttagatatttaaacagggatatttctgccactgacatgtaaatctttaataggatatgagatttggcaataagaaaaaatgccaagttgctggagacctggttcttttgtactattttaggtccaatcattacctcctgacattaccttcctcaaataggtttatttgttgaggccctactttgtattgggtagtgtgtatttaatactgggatgtaaagtagtggaatatatggtacttaccctcacaggacttccactctgctgatgacagacatatatgtgtagaaagatgaatacaaatacagatcagtaagtgcagaatgtcagcctagttctgtatgtaatcactgctgcagatattcatgggaggaatggatgatgtgtagggctaattagccttcaaatagggaagctcatgctgtgaaatattttcacctggtcaaaggatgaggggctgaatcttgactcccataggagacaaaggatctggagagattttcagatagtcactgaagatttccagttgaagtagaaaaaagctttgtgtttgtgtctgtgtgcatgcatgtgtgcatgtgggcatatgtgcatgcaagcttatctacatggttgtatagacatttctgtcttttagattccaaagtgacttcctggagtgatagtgaggctcctcaaaacttggtttaaaaccaacctgaagcattctttattttcaagatctaaaatttctagaagctcttgttgtgaggaagttttcataaaaccatatttacatatccccttcctccttctgatccttcctggcatttaatattgataaacttcctattcccttgcccacctctattttctgtcatctggacttattaatgtgtcttaacagtaaactcttgcatcctccaattgttctcctcttccttccccccaacattggcctccttttactttttatctctttcgttttcttccactatagtgagttagaagaaccaaatgtaaacttgtagcaagtctttcttctgggttgatatctgtttcctgcccatcctggtggccagacttcccaacaatgggggaaagtcatggcgtctgtttcattccttccatgctccatcaagaagaccgctttttaggatcaatttcctccctttctggaaaattgctcactatttagaaagaagaagtgttcctactctgaagctttcaattgttgccaccttaatggtctctctcattattcccaggcatgacagcatgagttttggtttggtttgccttccttgacatatcagaatggttgagatgaccttgcttgatggaccatgggcataaaggaactggttggttgagtgtcaagaccaggaaaaagtatggatctgtccttgttgggagccctcttgtctacttgcttggttcttattagccagtttggaggttgccttctgccatcttcctttcatctgtgtggttcatcatgaatcctggcctagcttctcctccttaccttatgcttaccctttgatgcagagttccaacattaatgtctgcctttccaacttccacatattacactgccctctacttcccactgtgggcataactcactgactgcaggactgtttctccagaatgtggatgagacctcagaatccttctcagcaatgtcctgagggtagacaccagctgatcagttttatcatgaaaattgaaacctatcttctctccctggatcttaccaaagtactcattttcatcttcagcctagatgtcttgctagacttttttcttccctattctttccatctatttcctatactttgttcttcatctattattggtggtgatggtgatatccatatttatcacactcttacagtgtgccagaatataaaggctacaggtatcatctcatttagactttaaagtcactctaagggatactgatactattttacaaatgggggcccagagaggttaagtgactttcctaaggtcacataattcatcagtgtctgagctgaacctgaaacacactctgcccttttctccctgcctctgcactaccttttacttccttagtacctcattacatcttccatagtcactgaattttattctttgtcattgcggcttatttaaatactgactgtattggaaaaattaaaattatggtatccttaataaaataacattgaagagggtatagatgtctgcactgggaatattctttgtgtgtgaaacaaaaattcaacttgttatagtcaatgaagtcaatggttcagttaataatgcctctaatggcataattctgctcagtgccggtgatgggtaccctcaaaatcagagactagatttaatgacaggacatgtagaaatcagcgctgtcataaaaacagccgggagaggaactccataggagaggaaaacccctagaaatggcttgacgttattggttccagtctcataaatctcagtctccgatccttcccgtgattccccctttccatccagctgcacctaagtgttccccctttgcagtgaatgcttgcatttcccagtgagtttcctgtgcttagagatttgtttttagatcaatgccattttttatgtgttgctcatgcatggaagagctctactttctctgcttgttctaaataggagaaaataattttaaagactccttttaaggtgtcttaagactcctctgtgtgtgacacccttcagaggaatgaccttccattttagggattcccttttttgcacccctcccttacccccttgcattggagtaagtctcttgagactcactacggcctaggaccaggatgtaggccaagtggaaacacaccaaagtgatttaatagaaaaggtaattcctattcaaacgggatagtcccttattcatttcctcggattatcatcaaatttatgtcaccagcaaaggagctttattgagtttcacagagatattccttttgctctcattgtcgttagttggcacgctgacattttcatatgtgtctcagctaatgcctcaaaattactccatctacaaatgtaacaattgaacagataattttaataagattcagcttgacttcagactgcactccttcctttctttatagaatgcaaattgtaacctgtttttaaagccgtgcaatgcagtgaactttaatgggatttgacaacatcatattaagcacaacaactacgcataatgtaccgaaaaattggacgtgaaattggaaacatagctgagaacaaagtaaatttacatggtttggtagcttgaatgtctgatatcatattctctcatgcaagccccataaaaaagcaaaggatttaacaatggatatcagcagaaagtgcttttaaagttaaaactgatggatggcttgtcaaaaaaaataattgcattggttggaaagtcgggatgcgtgctgagggggagagaacaggatatacagagaggatgatgggaagtgacagtggtctgtcaggaaggactggctgcccagaggagtgtgaagccagagctataaggtggcagagtagaacaggctgtcagagcgggaaagtggctttaataccctgaaaagcaaaggaatccgcctgtcagctttgctcagccgtgctgaaagaggaagagaacatggcataaagttagagacattaaacaagggggtgggggcgcagagagcagcgcggagagcacaggcagggagtgggaaggaggtgggggaggcttcgtatgtgggtttctggatatgttctttcctattatattttcccccttttctcaagggccaacaaattaaatttgaggggctggggtttctctgcttttgaagaaacgggtgatttaagagagtcacatgctcgtcccagtggctgccactctagttgaatgggtggctttcttacaagtgcacctcgggttgccttggccgatttctggcttttcagatctacagcctcctctgctgacctttctcctcatcggagtatgcagtccattctcccagagatgacaccaataccaagtcgtcctgggactggcttattgtctgacaaagtgctgtgaggatgtgacactttagctatgtaagaggattgtgagtaaaacacaataatctgatttttttttgtaaattttttttgccctctcagcattaggttttgaataatttattattccttcttcatatactcctggcggtgaggttaatttggtcatcttgcaggggcctggctggtaatgaacatttttatatcaggcctcggagtactttctccgtaagacataccacatgtttaccacttaattgcccaagttgcttgagagtgttagcgtctgggggggttggaatatggcagtttattgtacagaaatattttgtgtatttgatcttaaaaaatatattctgagagacatccaaattcttgaactgcatatggccccaatataattttacatttggtttagtagtttggagggggggagcttctttccaaagagataattatgtcattgtggaggaagaaggtgatggtggcagtggtggtggtaatggtggcagcagcagacacttacataagcattttctttttcttttttttttttggagacagagtctcgctggagtgcagtgacacagtctcggttcactgcagcctctgcctcctgggttcaggtgattctcctgtctcagtctcccaagtagctgggattacgggtgcctgccagcatgcttggctagtttttgtattttttgtagagacaggttttcaccatgttggccaggctggtctcgaactacgaactactgacctcgtataatctggctgcctcatttattacataccaggcagtattcatttagctcccataacaactctagggataggttctattaatattgcctctgtgcagagaaggaaactgagccccagagaggttaagtaacttgcagtcattgaattagaattcaaattcaggtagtctggtagcagagtccattcttttaatccatgtgctaggtacacataggcatgtggggaaccctgaaatgccaggtggagtcctgttgtgcctctattattcttgtgtgtctaaggctttctgggaaggattttattagaactgggcatcaactgcctggaaagcaggttgagccacctagcagggagcaagaccacagagctatcttctctgtgttagccgagtaaaaagtggagcaggggagagaaaagatgaaacagtggcaggaggatctttcctggtcacaaaagttaaccaacttccaagttagattcaaaacacttgtctgaaatttttcatctagtgctctgcagagacatgtatgtttacactctgcattcagttctaggttatagtaagccggtttccagaagatggagacctgcactcctggttttcctagaacctagctggagaagccgggtggcagcccgcccacctttttatcttgattttatgcagtatactatgaaattgctcactaaagagattaattagtggggtcttcacctgggtgtttatgggcatgtttggcagtttgggattgctcccgtgttcttcaagcctgcagggcacgtcttgtggattgcagtggtgtgctaccacactctagcacccactcatgctgctgttattttggtttcctgggcctgtaactttgctgtaaacaagcaaaattgctttctactcagtgggctgtttcctgacacagcaggagaccttgttgtttttctcctggaaatctctgggcttctcctatcctatctgatacttagaaggaacccttgcagacttacatattacagtaaggcgcacacttgtcacggatctgggttgacttcagtgtgtctttaggaagcctcccctagtgctccacgctgccctctggctgcagcaaacctaaaagctggagagcaatactgccagtctcaagttgcaccatcagggacaccactgagatttcaactcttgaatcaaagaatttaggattggaatggatagagcttaactagccttttcagtgcctcagctcaggggtctccagcgatagggaattcattatacccagaagcagcacaagccaacttatctgagacaagtagggtttgttcttaagatgagccaaatgtgtttctctagaatttccatccattggtccttttcctaactccctggggctacaaagatcccaggtgttaaatttgtgcatcccataaaccactgtaaaactgtataagtcttcagcctgtagagatctgcctgttttctccttcacttgttcgttccatcatgttcaatggagatattaatagctagagagagcttctatcaagactcttccctcttcctcttctcctcacttcttccttccagcccactcttcccaaccttgctctgcactttttatggctcacctactctttcaacagaatccaattccttgctttaatttcaggtagccctgagtccagaatttaggtgttcgaggaaggacctcctgaattgaggtaagggaataagacacattccccaaaatgagactgtaatcaagtggtgctatttccactttgcaaatgaggtaactgaagtttagaaaggttaagttacttgcccaaggacacacagctagtaaacagtaaagtagatttggactcaggtctgccgacaataaagcctcagctatttacaaagcaggtctaatgtactggttataattatggattctggagcccagcaggcctgggttcaagtctccatatactaattggtgaccttgggaaagttatttagcctctctgtatctcagtgtcctcattggtggaacagtaataataatgctacctgcctcacagggttgttgtgaaaattaaatgagaaaaagcatgtaaagcagttggcacagcacctgtatgtgataaccactcagtaagttttagtttaacatcatcatcatcatcatcatcatcatcatcatcatcatctatttttaaaattatgatagagaatgtcagagctttgcacggttggctatggagcctgaaatgtggccacctaactcttggggtggggggtgaattcacgcggcagggagctgcaaataaccctttggtggatgctttacaatggaggctgggtggggtctgggaagagtggcagtggctatgattattattttttagttttgggtttttttttttacactttgagaagattgctacagttatctggaaatctattgctcgggcaaaagcaggattgcgtgatacaatttaaaaggccggcagctgcatttcatccttttcacaagaaaataaccccttactccagtgaagctaaaaataaaaatggcagtacatttggcaaccacgcttcttcctttattacctcagcagtatctgaataaaatgtcttattaagcaagatataagggcaatgaaagggagagtaagtcaaattagttgacatctaaagcatggtgcatcatataccgcgagggtagttactgtttagtaaaatggatttaatgcttaatataaatgctgatatttagatggctatattttggcaactcaggaggaagagaggtggtttttgagctggtataactaggttttaggtcctttcctgacacaaaccactcatgtggcactgggtggcatgctccataaccttgggccccacttcctccatgtgctaaaggaagggtgttttctggcacccagtggctctgtggcaggatctcagggtaatctgggaagagtggcaaaaacagggctctgaatacccaccccactcagacaggtgcaacactgcctgtatctgctttacatattgggacaactgggtgagattttctttggggaaaggattacacgaataaaacataggttgtcaaaccaccagatttgattatttctaaggaaccctacaattctcacctttgaaagttccaccatgccaagtttgaactggctctgaaagcactctgggtcctgtttcagctctaccacctacagtgcccagaaaggacctcggggtccaggagacagggcagtgcactagatacagcacaaggtagggtgtgaccagggaagaaaagtggtggcaaatcccattataaacatggatggatgcaggcttgtgtgcctgtatacatgtgtaagtgcatatacaagcatttaaatgcatgatctatgtgtgtgtgtgtgtgtgtaaatgaatgcgtttgtgcatatgttggtagaattcatgtacaaatcggtttcttacatttgtgcatagagaagatgtatgcacagccataccatcgttggccaactgttgtctcatttatgccagccatcaccttggtgggttaaccttcattttcgtggttgaagtgaggaaactgagtcttacagaagctaagtaacctccccaagttacatggctaacagtttgcagagtagagggatcatactgtattaggtatttgttttatatatgcctgggatagtgccttactattagggccctggtccacatagccctcaaatttctgtgtgatgaggagagtctcatatatgacagggaccactgtgggttagtcttttagaattttggttttgtttgatttcttgtttcattacttttgggatcctgtagttgagggttacaatgacatagcatgaccagggcttatcccaaccactcttttcccaaaaatgactaaataatgtcgtcaggagtttgttcaggatttccttctttgagagcttccttccaaaacttcttttgtgacagagttgggagcctattgaaaaatgaggctgatcagtcacaagtcctattatgcaaagtcattcttaggtactattggcaagtaactgaatgcaatcctagcaaagaccttaggaaatcttgtttccttttattcataccatgaagcacattgaagactgtcagtcatcctgcttccttggaatcatatgctgagaggcttttattctgaagaaaatcatgaaacctgcgaatagatttatgctctgcttctaatggttcatgaagcctaagtatatctaataatagttctttcacctgatttgcctaagactaagatcttgtataaacaactctcaccagaaccatcaatcactgtttaggaatttaaattttaccaactaaaatgagaatggaggaagggcaagctgttttctgtgttgagcttaggccttttatagatacaacactttggggaatttctcggtgtcttagttggagatgaggagaaactggagcctttgcacactgcaggtgagagcatagattggtgcagccatttggagaaatctggacttactagctaaataaaatatatgtaatgtatgacagaggtcaactcctagatctataactcagcaaagttttatggtaagcagacattcgatgatggtgatgatcatgtctttgttgctggtttcagtgattgtgactgttagactgaaggctatttgagttgtagtttattgacaagtggtcaagacccttttcagggtatattctcaataagccatttgtcaaagttgctgagagagccttcatctatctccactcctatgcttcatacctgctatatattctttgagtgcaatgttcatttagttgatgttgctggaatgtttttgtgagtgttaattgtgattcttagaaaagaagtaatcttggacattaaaaacatagaatccccaagttgagatttgagattatttaattcaactaataagcctaataagaattccagctatagttattcttataggtgatctgcttagattctcccagtactgggacatttgccacatccagagttattagaacattctaccagggacagatagactacaaagtattggtactattaggcaaagttgcaggattttgccaactgaaaccccaaggcattttctaaggaacagacaagagacaattatgccatcctatctagttcccgctactgcatcaatttgcttgggagctaaaactgctttttactctaaaaacaagttgaaaaacctgagtatctctccagggtggaatcagctgcatatacccagggagataaaacggtctgaagatgtcatgggcattgtgaatagggacagcagaggttacatccagtgtcagaagtcagtcaactcataggcattcttgctgaagaaaagaggcaggaaggtcactgccaaatgtgaccttgcctgaacatataaataactgttcatgtgtctaaattgtcatcattaattaagtagtgtttcatattaaaggctctcagtccagaatctccgttactttatagatgtctgtagcctcatgaagacccagatttctaggatatcagcgggggaatcatctcaaatgatgatagtaatagacatcttggtccctcaatagaagatgggattgccaaaatacttctggaagtcattactgatgttataagtcaaggatctgaatggaaggaaaatgcaaaaccagaatctgtattatttccttcctctaagcttctgctcaaggaagtccacccaagaatgctggtgcatcagtgagactctttagcagagagaagagattccaggcctactgatgcttggaacagccactctcatcagcaatactgagctacctgcttctcttgctggggaagtcctgtccatggagccggctttaccagctgtgcagtcatactcagggtgtgcaatgttactgatttaggagcccatgttcacacattaggatcaacccaaaccatcatatcctattgtatgtcttcttcccctcaccatgtcaaagctatgttaggtcacgaaatccctgacagctcagtcacacacagagtgcccagctcaacaacagaaccagaggttcatgaagtcagttttgctgttattgtgagaaaagacaaattgcaaattatctcaataaaaagctgttatcatttatatcaataacaagttttttgggttctcatttcaagcttgattatattagtacatttatagtgtcttttgttttttccctgtggctgtactttcttaagaagctggaagactaataaacactgatgctcttttgccacagatttcatctatgattttgatttaaagctttctgatcagtatagctgactgatcaagccacatggctgcaaattacttatcttgggttctccttccaattgggtataatagaggggatggctgtagagaaactcattaaagaactcaactatttgggaagctgaggcaggaggacagcctgaggccaggagttcaagaccagcctggcaacatggggagacttctggtctacaaaaataaaaataaattatctgggtgtggtagtatgcacctgtggtctctgttacttgggaggctgaggtgggagatcacttgagtccaagaattcaaggctgcagtgagctatgattgtgtttctgcactctagcctgggcaatagagtgagactctatctcaaacaaaacaaaccaaaacaacagaaaaaaaaaccaatgaaaaagaaactcgactaatctaagcaaccagcctgagtaaattatctgcccccttccatgaaaccttgaaaacataaaatcatgttgtttattccaaaggctagtagttatcactttatcttggctattctaaagtgcagtacttttgtgaattttgctcattaagtaacttactgaagttttatttaggagtctagaatggatgataatgttgaagattgttagggataatgtcaagctacttgacataatcaaccaaaaatgctgtatatgaaaggtgttttgtaaaccattaaattacttaaccaaagccttagtcaagaatcagtattaattcttcagaatcattcaggcgtagattccttttgaaagtgacttaagatgctcacagatactctagttctagccctttctgaaatagtcacaggtgctttcaacacatggctggccagatgctatcatttctgacagtgggtctgaatttaaggaagttgtggacaggaaccttatctgagctgtcaccatcctgactcatcaccttcaagcaaataatcaggctaaaaggataggctactgggacatcctaggaggatgctagaggagattggccaacgagattcactggactcttagtctctcaacctgtcactccacgctcatccatggaaattggctctgattcattactaatggagaaatagttcaagacttgctttgcatccctacacctatgtttggatgaggacttcaagagtgagaatacatttcagatacagttatggctaaattgtagtctttgcatgaaaaagaaatgacctggtccttgttaagagcagtggattcagcccaaggtggtttcctgatatagcagttgaagttgcagaagattcagagtgcaatgtatgtccctgcaagatactgtagggccagtaatgtttgtagcagtaattcctgtctggtcatgcatctgctagaatgtcgtatctagtactctgcacccactaccacctcgtagaaatagcttcacaagttatatggaggattggtgagacaggtgggagggtattcgctccaaggaggagaatgctgtgagatagccattttttctgcctttatattcttgttggggatatgttttttaggtgcctgtagctgtctcctgctgaatgggctttgttcagagatgcatttgcctgtataagggttgtggttttagaagactgcttatctccctcctagttgctcactcttacataggacagccatgtccagctgtaaaggtaatatactgcacagctgtaaacagcatccctaagaacaagtacatcaggaaatgtcttggggttcctagtagcagttagtgatgagaggaccaagcagctccagccttcttggttagctctgtggccttaggtaagctattcaacaatagtagtccttcatttctgagtctgcaaaatgtgcatgggtcctgggtaaggagaaggcatcacctgctgacctaaggaaagtgaaatatgagtgaatgcctttatgctttctttatggcataaacatgttaattacactcattacacacctcagagtgtccagtgccagcctttcccctgagccatttcctttgctatggacctttcggttttctgggacactttggtaaaaggatggagacagcaattaaatatgccttagaattattgtcattccatgttttatttttgccttgggtgtctttatgggagagaggaaaggccaggagaggtatgggccagtagacccctggctacccttggaggtgtcctttctctgaaccttgagttgaaagcatttatagggaaggaaaaagcttagatttcttctgtttaaatacttttcttccaatagaagacagagtgtgtgccagtgccagagacctgggtaacagtgagaaccttgaagaggcagtgagggcataaagggtgtgctcctggctagtggggaagagagacaagtttggtgcaggggtctaggtaccactcggccagcaggatgggcactctcggtcagtgcctgcaaatggtgttgatgtcagtttcctgttcatctgggaatgtcctggcaacacatgctggtttgtttcaggctaagccactacctggaggcagtgtgaatgcgaagaaattgggttgctccctttttcttttagaacagttttcctcttaaatagttctgtacaacagttggagccaatctatttataactgagttttattgaacctgatggggcttcactctcattgagtccatcagcggagatttccctcttgggcttttttcatggcaggagggtttcctggcttaatgggtgctctgtcactagtgctcctggtccctggtccagcttctctcttggtttgctctcagtttctcatcccaaagggaactcactacagccactcccaaagaaacaagaatcctttttctttcccgtctccatccttcccttactcctgccactgcattctgctactctctccccacaaattccctcaaagccttgaggatcccaagaaagagaagggcaagggtgaaaaatttaaaactgcccaagatggatagtgaaaacaccatgcataaataaatttcagcaaatcccccggatgaacaatgattgtgtggttgaagacctggctgaataagtgtgtcaggtactgattggaagcatgataaatgcaatgacctaacaaaggattgacttctcctgcagacaggccccttttaatggatggaaagggaggaagcttcatttagaagggaaaggctgtttgctgtgcagatatgacaaaggggaagtagacaaccattgatttacgtttgggaatgacagttgaaaaattcagcaataatcatgacaaatgagaagagatgcagtcagaggaaaaaatgtcaatacgttaagcctgcaaagaaatgccaaggtcacagagaaaggttcccaaacttctggttttgacaaccttaatggaaataataggaaagatgagggttcaggttaaaagggatggcagggcatgaagggctgcaggtgtgggtaattagtggtgagtttggagagggagtggcaggaagtccttctcccaccactgggaagccgtctgtccacatgcaactgaggtgcttcctgctgctggcaggcctgccctcctcccagaggtttggaaaatcaggcaagttattttaatgtcagtagtgacagcagaaagagagaatgtgggctgggtgtgcttgtgatgcttgacggggcacatcaaatcagaggtttagctctgatctcaggactgcagtgtgtctgccccctcatttttatttttattttattttattttattttgtttaaaagactgattataagtgagaggcagtgagctctaggttatctgcctggttgagtttggtaagatgtctccttgttttatatttatcattgttgtaaagcacccggtacattgagtcctacatttctgcactctaataagagaggcacaatccaggatgttctgtctgtgggcgtgagaagtgggtttaaaaatgtgcatatgtggatagggagggaggtgacctgggaaggtgtggaggaatcctcagacctgggtcattgtttactactaactctgtatgtaaatgtggacaatttgctttacttctccagagtctgacgagctcatctttaaaatggagaaattctggagggaaaaggtttctgacattctcttcctggtatataattccaggattcaatattatatctagacatggtgtgtggttttaggcctatttgcatatctatttgtatatacaaatacatatctcacatatttacccgcacatatctttttgcttcactgtgttggtctgtttgggctgctgtaacaaattaccacagattgggttggttataaacagcagatacttatttctcagcgttctggagactgggagatccaagctcaaggcagcagtaggttaggtgtctggtgaggtcttactttatggttcatagacagcgacgtcatattgtgtcttcacataggggcaaacaaaatctctctgaggtctcttttataagggcactaatcccattcaggggggctccactcttatgacctcaccacctcccaaagatcctacaccctaacaccatcaccttgtgggttaggctttcaatatatggcttttgggacacaaacattcagatcatagcattcagccatgcatgtatttcagtattttagtctgcagttaacactgtcttctcatctttattttggtttattctcatctaaatattgtttatggacttaaccctcaatattataaaatcatccttctgtttactgggtaaaaatgatgactcatatagtttttacttttgggggaagaagccctaacacccctaaaatacgtatattgtgaaaccagttaccagttccaagaatgacaagatactctctgtgggaattcttcagcttcagacaacgtttgaactatgactacatttttgctaaatttgttgaacagagataaatatttttaaaatcttattttatttatgtgaaatcatgtgccaggaaaagctccaccctaaatgaaaaatgattttattttaagccaagcaactccttttagataagccttgaagagaagttatctcatttaaaagaatgagccattttggagctgctgttgtatcacaattcctcttgtcagccgagtagcttgggggcctggccctcacagggttatccccaagccttgtgtcaccactggcacgtggctgttttcatttgaattgtttgagcatgtgaaagttcaaagtaaagcaggtgctgtgtttgaaagcaacactgccccccgtaactcaagcatgtgcaccatcgagttgccaaaagctctccaatttccatcagttaagacaccctttaaaccatagaaatgaaggggggcaggactgggttataaatgagtgggatctggtatttgagataatcttgaatctataatggtttcttacgacttcacttccacctggggctgcggagcgggcgtgtaaggaaagaagcctcttagattaaacattttctaatcagctttatcactcatatctgaatttatcttatttgaggaaaatgccaatatattagcaggcatgtatgatacacaaggtgaccctaccaacttaatgacataatacattatccttaatgaagtcaatatcttgtcttttagctgtctgtctattggggcgattaattgcagtgtcattaaagttagctctcttttcatttgagcttgacaagtcgcataaaactaatgttcttagttatcagctactggaataggatggaggatggaggaaattgtaggacaaataaggggtactgctacagctaacttgaaggactttttccagtgactgtttctttaggtctctcctttcccaggctctcttgttaggtgaaatttaaggcaaaggtagatggctctgatttagccaagggttcaagaaggagagaagaagatgctactgagaattacacccaatttgggagattttgagccatttagtaacaggagcttgattactgtcagggtttctccactaaataaatttgccacgttacctcctagaccaagctgctagcctagcctgagagaggagccgataaagaacacttgcaaccatgttttcatttagctttgaagtttttctaatttaacaggctttttggaagaagggaggactgaggatgggagaagggatttgtgcccgaaccatgctttgcaaatggttccaataaacaccagctcatcatgggcaatgtgggagctatagcgcctggtccggcactaattgtgaagccaaagcatcactccctgccttccccctacctctggaactacgagacaggatggctgtaatttacagtgtgttatctttgtctatagcggcaagatgatatgaagtaaatcaaggtacgagtaatgaaagactgagaatttattccttggagcacactttaaagtgtagtatctgttatagtggcactgcctgaagaccctgaaatgagacttggatgaagggcaataaagcagcatagaggctcatgttaatattgtttgtctgaggttagtaattgggttctactgatgagttgtgtgaagacaaagtgagaatcccagctagtattgtaaatcttacattgttggaacaagaagcaatcctaacaaatattgatcctctccgtgcccagaggcgaggagggaagcagcgaactgcagagcactggcctgtttcaatagcaccaattaccttagtgaaaccagcgctcggcatgaaatcccagggtggccgcaaacgatgaattagccatgattaggctttttagatggatccccccaaaatcatgccagcttaacattctgtctcaattatccttgtggtcctaaaaacatattttgtgtgaagtgataccttccagtggtgaggggccctggacctgtgtgggaaccagatgcaaatatatggccagctgctgccttcaacacagaggggctggagtatgtgcacttgagagtgaccactggacagatgcagctttccactctgaattcactgaacaccccatatttggggacacataccccacaagcatttgactttgttgttgtttttggttgtgttgtgttctgttttccctatttgtcgtgaattatgtcctaaagatccttggagagatgttctccaggggagaaaaggcatatctgctctgtgattttggggggctggcttcctgttcatttttaatgtgaagatctgctaaaggtctgtgctcatcttgtttggatacacagtctccttcctgggaatcttccctgagttctcactgggttgcattttggacccatgggaaagagagagtgttgataaaacctagagaggtcacattccactttgttacttcctaggagttcgcagcttttctctcctccattacctttggctgtgagtgtgcagtcagtactctcagaggtcattcctcaggccagatccggactttgggctggggtgaactaggtaggtatttggctctcaggcttcctagtccccatcctctgtacagcatcaaccttgtgcacactgcccagccaaatggctttggctgggagaagagccttccctgggggacttcaaagcatgtatttggtctttgatatgacactgtgacatgtttgtaccaacacacgtgcctttagcagaagaaagataacatcagaccccccaaatctggcagagggtgagcaagagtttggatgaagagaactatgcaccttctgggactaaaatgggagagggcacattttcaggattccacgacccagtcattaattaggtgatgaattcaacagatatttattgagtacctaacttaattctggatacacagttgagtaagatggagtttacattctagtagtgggaggtagcgatggtgatggaatataaacaaaataggggcaatttctgatgtaaactgaaaaatacagaaggcattattggggcagtaagcggctgggggtgggaagggcgtgttgataaccaggtggactgaaaggcctttgttctcctcatactacacacctggcatctggagccacctgtcccctcatgcatctgtgcccagtcttctttctggtggttgctctcacactgttctgaggacagctgaagtgccctggaccccatgtgtctgttcattttccaaggctcaggtaaaaagccgtgccttccacgaagccattctggtttccaccaactaaaagtgagagtttgcaccctgagttcctgtgtaacctcctatctctgttccacattggcacttggcactttctgtcttgtgttagagtagctttgcgtcccatctcatcgccactccttgcctgtgagttccttaagtacaggaactatgtacctataatatcttatccctgatatactcagcagtgtcttgtgcttagtaggtgcttcataaatattcattaaataaaataattacagagaaaagctagggaaatttatggggtgtgtgtgtgtgtgcgcgcgcgtgtgtgtgtgttgagggggtgtttgaaatagtctggggtttgatctaatacatagaaatgcttccatgaaatagaaatgccttacagttgtgtgtagctatttcactgagtgggtttgttatatctgaatggactagtgatgtctgcctgcctctctgggtaacaaacacattttggagggattgttaacttgaaggttgtaataaaatctttaccactctgaacagctagcattggtgtctgctaagggggaacaaaggcaaaacgtagttctgttggtgaaaatagtttgactgtgtttaaaaactaatcattctgcaaatatcaacaagctcagcagatgcaagctagccaccttatagtttaaatggagcccttcacgctgtattggaaatgccgccgcctccagcccaccctatactccacaggccagctcctgctcttctggccaaggaaaggcgagtaagcaagtctattgcccgttggcctcctgagacacctctgaggattaaataactaatgactgtaaagtgctctgtgaaaagagagtgctctataaagtgttattgttggggctgttaaaaatggaaaacgacttttaatttagaaagagaacactcagcataaggaggggtggctataaagcttttatcaccactttgctttcggaggcttcttagctgttggtgttggcgccatggtttgcttgcccaggggttctgtcaccgttcatggggtttaggaaagatgccagcatctcactggcatggtgccatcctgatccccttcctgcattgtaacctcgtgggcagatctgcgacttgattggcttgggttgcctaacattgattagaatttcctaagagcgagccacctggaatgtagagtatcctgtgatctggtagcttcaggaagcccccaaagcagccatgcagaccacaaaccacttgtaaagattggggactgatgacaatcatgccatgtggacagtatccaggccctccttccatctcttgaggaataggactcagctcctctttctgttcaatgaggatattgagtttttatcctaaattcagaatttcaccaactccttctaggctccttgttcatgtcctactctctccatgtcacatttatgtggttgggaggtttaaaatatagtgttatacctctgcagtctgtattattattttacatattatacattttgtgtggatttgtaatcacagcgtgtagggtttgcttgggcaggttctcatttctaacatgtcatcctgccagtgggatggaggctctctggtcttcttcttctttggctcctctgactccaaacacttcaacacctacccttcctcagcgacgtgcagccccttcaagaagagagcccataaactcagtgtttatcatacaaatgtggtgatgtgtttgcatttttatgacccagctaagtggtgagtattcatttgtgccacctcaccccagatgcccatccagaggctgagctgtttatcatgctcatctctttcccaaagcctgaacaaggagcttgggaccactataaacatgttccctttcaataaagaggaaattattatcatatattttggtaataaccaataacatttcaaattacttacatttatggcttataatcaagcttatgcttaacctctaatcctcatgaagctggtgatgatgggctcggtagttaaccacttgcgggaagttaagggcaggtagaaatccacctgaccagtaattaaccagagaagcaacccatttctgcagttgagattataaacactgtgcttggtttatgtttaattggcaacaagtgaggtgaaccccattagttttgcagtgatgccctggaggatttggcctggtcaacttctcatcaattaatgtgctgatgagggatgctggttgctgcacactgggtctttgggttcctggtctttgtttctttagctgagcatttgaggagattgcttggaacatagttcatggctggcaattgaaggatcacagagacattgctctctctgtaactatgtgttctgattgcggttttcagtagtcttttgtttgaagtcctatcatccatgagtctggatttgtgtgggatatgaactactgtgatgctacaagtcatgtacttagattggcttttgagttgaccattcatttggagaggcttatataaagaaatgggccactttgtggtcaggccatttttgtctccgagtaggttaggaacagggatccaagggagtctggttccaggatggatgtttcttaactgttagatgaagttaaagggttctaaattggatggcttagcaaaagcacccactgatgttttcagcaaaaaaaaaaaaaaaaggactatgagatagaatcttccagagtccactcttgtttcactgctttgaggattatacctttaagcacattttaacttctaaatcatcccaccaggaatctcctatgacactcatggaggagctttataaacaacttagtcatcccaacaacctgtgatgaaagtactattctcccaccattttacagatgagaaaacagaagctcagagagcttcagtgatttgtcctaggcaaaacatctaaaaggtacacagccagaaataattagttttgtctaatatcaaaactcatgctcttaactgctgtactttattcttacttttatgtcattagaaagaaaaatgtcccaagcaagtggaattatcatggatttcctctctgttatagaaccaagaatgtgaattgatctcctgtgatatgttagctgctgtatttgggactcagtggcatattgggagatattgacatattaatccaaatcaaacagttcatttttggatgataaactattagagattatttgctcagtttattagcaccagtggattagagattggccatggttgcttagcttcatgaaatagtagggctgaaaggagctttgggtagttatctagctcaattcaacacttattcaacaattatttattgaggacctgctatatgctcatgctgcatgtggttgtatgctctgctctgctgtctcacatacacttataatcatgtactacaatgttaacattttgcttaaatcgctatatatctttgaaagaaattgaaagaagtgagctttacatgttaccccatatttgtcttttccactgatcttcattcctttttgtagaagagaaatttcatctggtaatatttctttccagcctgaataatttctttgaatattttttcttttatcagctttctggcaacaaattctgtttttgtccatccaaagttgtctttatgttgccttcattttcgaagaatattttcattggatataaaattctgacttgatttttgttgttttagcagtttacagaggccattccatcatctctggcctccattgtttcttatgggaagtcaattgtcactatttaatcattgttcccacatgaagtatcatttttctttgcttttaatattttctccttatctttgattttcagaattcagaggttaatattcataggtatgattttctttgattttgtgctatggatttctgtaagtttcttctatctgcgtgtttaagctttttgtttttaccaaatttgtgggggttttttgccattgatcttcatatatatttttttctgctccattctatttttttctcctactgagactctaattgcatgtatgttagaccatttaaaatactctcataggtcacagtgtctctgtttactgtttctaaaatcctttttttctgtatccttctggttagataatttctattaatctaccttcaaggtcactgaacttttcccatttctgttctcctgttaaggtcaaatcatgtgtgtgtctgtgtatatacacatatatatctatatgtatatatatataaaataaaatatatatgtatattttattataaatattgtgctttttagtttccacattttctttggttccttttaaaattctagttctctaatgagaattcccttctatccatctgttcattcattataatcatcttttcccttaagaccttgttcatgcttattacagctactttaaagcatttgagtcttaattacaaaatctgggttatctcaatgttaatatctactggcttttaaaaaaaactcttgactatgggtcacattgccctgtttcctattcttatgttgtctagtaatttattgttgtgtcctggacattgtagacaatacattgtatagacactgatagattgcaatttctggtattacctttccctcctccccactttttaaaaagcatgctgagattttgttctagcaggcagctaacttggctggactcaaattactaattgagtctctcatgtggaaagtagcccctgaaatctgtggtcagttctttcagacttccagttgttacttttcactctgtcttgtaatcttcccagcatatgtgcagtttagggtcatctcaggatttagttgtaggattttgcagactttgtagccttaccctttgttgttctcttctttctgggatcactcccttcactttccaactgttctgccagtggcaaaattcatccttaaccacccaagaagaagcagaaaggtgacttcctgcttgcattttagccactccatcttgcagacttctgttaagggccagcttccatctagcttctgtctgcttttggtttctttccggtacccacatgtagtagtttttagaatattttgtccaaattttataattttcatcaatgggagggtttgtttaatataagctactctatcattactggaagttgaactttagatcttctcattgtttaagagaagacggaaatatatagatttttctgtgaaatctcttgattatttactctgggcagctacattgatatttaaaacaccttgtgtagggaaaaaaatcatgcctatgggctaaatatggcccctagaccctcagtttgcaaaatttgatctagttcagcttgccattttagagatggggaaataagttcagagaggggatgtgacttctctgaggccatctggtatatcattgcagattttcaactagaactaaggtttctgactttcagctatatatctcttttgttaggccaagttattgtccctttctctgtctgctagaataggcaactgctcagatgcactggctaggattcccatgggagacatcagagaataacccctgcaaagagtgggaaagcagtaagaccagctggagaaggagcaccatcgtgggccattactggactgcttttttctcttccacttggcccacttgatatttggggcactgtgaggacaggcagacagctgcctggtggactgactcagtcctcctgaatctagctctcttccagtcattcttatgtttaaggttaccaattctccgctgtgcccatgtgagctatttgatgttctcatccaaagcactgtcacgctagataacttttttcctgaactctgtcctgtcaccaaatgtcactgtgcccctgtgcagggagacatggagcatctgactgcacatgggccttgggatgcttctctcataaatggcagatttaggaccagacaaggaattggtgcaccagccataaatcctgagaagaataatgccagattcatctggctgctggcgtttgatttgtgggtgtgtgaaaggtcgcacaacctcttagaggagtatggtggggaaaatatggttcggattgcccatcctagctccttcttgggctttggatgctctacaagtaggcaaatggaaacagtaaatatttgggattccagatctggtcctttcccattttataacattagtaactttgtccttaaaccttagtttccctttctgggctcctttcatcttctatggtagttacatcccgcctgctacagactcctctcgtgttctcggccactcaccttaggcaggggtccactcttaggagaagatcttatgtcagccacaaacccccagtgcaacaacactgcagaactctaagaaacctttcaagacttctggttgaacaccttcacgtcacataggaggaactggggctgaaaggaacaggaagccactggaagcctgtagctggttaggggcagagacacatctggaactcagttttctaggccctgccccacccatccagtgcttttcttcacctcactggaaccattttgctttggcgtgaaattgtctaaaccattttatctggggtaaaaatcctctcggcctaagggtggacaatttgccccaccttctcttgcccttaatcctagtgtggtactagttttaactgtatgaaattgccaatatctgaccagtcttgacctacaaaaatgtcagttttgtgcggttcaacctaattctggcctttttctttgggtgagtgttgatttgggggatgagttggctcaggtgaccggaacatggtgctgatgagctgagatcacaggtcagaggactgtgtagctttccaagcttgtctgtttccccatgctagttcgcaagcctcacttcaggcagccatcctgacagcagtgctcccattgctgggctccggatattcatgtaggcaggtgcccagagtgcgaggaggcccatgtccattccatgccactgcagtagaagggaaggggagggacccttgggtactgatgagcctgactttgagtcctgggtctaccccttttagctgggtgaccttgggcaagttcttaagttctctggtttttagttttctccttttaaaatgagaataaaaagattttcttcatgatttgtgaaagttaagtggcacgatatgcaaaagtacttggtcagtgcttggcacatagtaggggctctataaacagttatttccgaaaacacacacatacttcacggtaccagagtgctgagcctttgactttgggcagcactttgcaccaattcatagatctctcccctttctgcctgtctcttctgaatcttagagctcgttgtttcaatgttcttgctcgattattggattctgtagataaagttcgtcctcacagggagactgtatttttgttgagggcagtgatattatttgggacccccactattacttcttcagccttaggtccatagaagggccttgaatgaaataaattgttgaataaaacaagcttctttgcagacactcacatgcccactgtataatccagtagagacctccccagcagtgtttgcataatgttatacgttccagccccacatttaatggttggtgattgtgagggttaaaggtggcttttctcaaattgtagactggctcttagagtctgacaccagcactctatgtcctttgaggggagaattctccttccacccatagattatcagagaatcccagccaagttccaattgccctgtgataatgcagtactttgttcccgagcaggttaggaactgatatccccattatgtggcatatcatgaaatgaatgttattgttaagtgtaaggacagggcatattagtggtatcttttattacgcagtcttcattataaaagaacagctattgctaaagtagtccccatttgataggtagtgggacattgttcttgtgttgttggtgctgattaaggctgggataatgcactgttcctgcctgttacgtccatcaggaaacaaggccgaccaaggtaaaatagatgagcgtatgttggcgacagattaaaaagactagtgtaaagtccattaataattctcatatttaggatttggtttctactgtacttactgaatctgcaacatttaatctcttctatgtgagaccagctgagagaaccttttctcccccttctgagtgataggcctggattttccgagacagtgcatttgtctgtcaggacccatggctgctgtggtgatttacttgccatcagatgatgttggtgtccggttggtgatatagccttgctggatatggggaaatttgttacctttagctttgacaggaagataattgctgatggttaacagaactgagccaaatccattggtttttcagtaacacaagcataagactggctttgagaaccctgcttttccctgcatacacttcaattctaagcttttgtgtgtgtgtgtaaaatgtgtgtgtgtgcatgtgtgtgtttgtatcttgagggaaatgcaccagactccagattattctccttcttttaaaaaaaattgctgcagcgtactagcatgaggcctgaagaagtgtttgttcactctacaaagaaaagaccttaggtgagttggaagtgggtgtttaggaggggtgtcctggaataccagaagcagctggccacttgcaaaaaaggtttgtcgttagtagggcattgttttgttaggcatctctcctgagaatacataaatctgggcctccatcatgtagcttgtcaatttgtcttcacactgtgcaatcaagtgattggttcaacaatgccttgtaatgtttgagccttgagggcttctcagtaaaagtcttaaaatgttggaaagaaacttagaaagtctcaggggatagccatgtgcttcaaagagcagcgtgcaggttctggacctgggatgatgatgggctcacgtggttttcctaggcacaagggttgggggaaggccatggggtataattggaggagtcttaggaagaaatttagagaaggaatagaactatcctctagcccttcctctctcatcctttggccattacaatgaagggtccctgggaagccccaatattatgcttctctccttgggcaccctcgatttggagcttgtgatgatctacctcagtggcacaacaggctttgaaaacacccatatttacccatagggaagcttgctttttgaggaagccagagatgcaaccttctatctgcaggtactgtgtaccaagagcaccagttctcacctcccttttcttctgccccaaggaaaatttccattttgccccaagatgttgcgaagagggcatgaagtgtggatactaccaaggctgccatgtgctagtgtcatgacgttttcttggtgacaggaatactctttctgaagcccagagaactctaggtccttccagttttgcaggagagggtctctggaatcaccttggttccccaaagcagaaaatctagaagagtccttgccaagacggcaaaatgtgtgaggggaaccagatgttgccctccctgttcagccctgaatgtgggtggctgtggcctttggaggctggggtcaccccccttcctcattgctcacatctgtccagtgaccaggtactcataatcttttattaagagactcatcagctctgcccttctttccctctctgtagccactgcccagggccaatggcactcatcacttcctccctcaatgtttgcaatggcacctcagctagtttgtgccttcagcttccctgtccttgaatatatgctactcattgacttgaagcttacccttctaagaccctgagctgaccagagagctctgacagcagtttgctgtgtctctattgcttcctaccttatgtcatagacagctctgttcacacatgccccctctttccttccagactgcaccctgtttgagggccgactcagcattttgtgtttgttctgagatgttcattcctttcattcctgcttgtttagttctcttatcattcaaggcccaacatcagagccatcactcctgggagatgttttctctttctgctaattgaagtcctcttcggggacttgttatattattaatgacaatactttttgtgcacacctactagctggtaagtcccttgaagtccagggccctatggtgccctattcttcctccctatcacctggcattgccctctgcacacagtgatcactcaggaacctttaatgagtgaatgaatgaagctagagtgtgatgatctccttatggctcctggattgtttcttgctagtgcctggtaaatgacttagttttctatgttgatgtttcattgagaacctactgcgcacacatcagtggttagtcctggaaagcagggtaagatccatgtgccaccacttcctgattccatgcccaaggcagacatcactggtggccacagtgttcactctcagtgaggcccaatatcgcctgtgaacttggctccacgtgtcattcctggcagctgctacccatcattagttagtatttgaagtgtaactgtcctgccatccctggttcagctatgatgagaggtcctgagaaagctgacattgtcctttcccaagggaatttacagttcactaaggagattaagtaaatattttaaaagtacttagtatgtggaagatttaagtagtcacacaaggcactaagtggttcagagctaagcgagtggtggtgggcggtagcaggcagtaataatctggggagcttggaaagtgaggaatgctgagccactgcagtcagagccgacttcctggaggaggtggctttaacacctagaggaattgggagaacagtctgtggcaggaggagaaacagcccaagcagctcctcagaggaggcaggccaaagagggaagagctttagattcttttcttatggtcagggcaacctctagcaatggaaagcccagatgtctcaaagacctggacggcactgccatggcattctccttgatttgcgagctggtgcatagtcctgaagagtcccttttaaaattcttcactctgaggaatcacttaaaacaaatcatgattcttgaaatctgcctctaacccccaaatagttttttttccacggtgaagaactggaatatttctgtgtgtttgctttgctctccatgggtaacctctcttcctgcatgataaatacacatttgaaaatattgatttgctgctacccctttgaaaagcttaagaaggctgacctctgcctcagcgttctctgacttgaatttttcagactgaccaattgacccctggaaaggctgagaaacgttacctgcggtcctggagggactttctgggggacggaggccacggtggtggcggccacttggcaaatgcctgaaaggagggccttttaataaaatgcagtatgtccatggctcaaatctaatgacttttaaatagctcctgggaagaggaaagcctccatggtggagcccaggagtcaccccgggggaagtgccattttccagactcatctcagaaaccctggggtcccctcagccccaagtacatggggctgtgttgggcctcaaagtttgcttcttctcaacctcccaccccgaccccgccgattgctcctcgttttattttctttccttggttttaccacggtatgacctcgtgttgtattttttctgaatgacaatgaaagtaattgaaaatattgattggcagtacagttaagttgtcaacacaaccatttaatttgtcaggaggacttgttaaattgtcaaaaatcatataaaaaaactccttcagtcactgatgatatacattagagatgttcatgaatcaaatgggccattttggagataagtgttgaagaaaaattctgaaatgggtttcttcagatacgtttgtgttctctcccactctctctctctctgatcacacattacaaagaatattggaacgattttggcaaggcaaggtgagtgagggatacttttttgagtagaggcctcactaagggtatcatggcagaaataagatcatttatagcaattaaattagaagattctaatgcggatgccatcaagttatttattaggacaaacgggttgggaagttcctttcctccttatatgtaggatttaaaatatgtgtcttggaatatttttttcttacggaaattctttttttcttttttgagacagagtcttactctgtcacccaggctggagtgcagtggtgctctcggctcactgcaacctccgcctcccgggttcaagcaattctcatgcctcagtctcccaagtagctgggattacaggtgcacaccaccatgcccagctaccttttgtatttttagtagagatggggtttcaccatgttggccaggctggtcttgaactccagatctcaggttatccgcctgcctcagtctcccaaagttctgggattataggtgtgaaccactgcacccagcaggaaattgtctttttaaaaattatttaattttttaagagacagggtctcgttctgttgttcaggcttgagtgcaggggtgtgatcatggctcactgcagccttgacctcctgggctcaagccattctcccacctcagcctcctgagtagctgggaccacaggcacacaccaccatgcccagctaatcggtttttaaaattttttatagagatagcggtctcactatatagcccaggctggtcttgaactcctggcctcaagcgatccttctgcctcagcctcccaaattgctggaatttacaggtgtgagccaccatgcctagcaggaaattgtcttttaggggctcttggctgctgactctgccagccctgtgtgaggctgagtgggtaataccagcttcctgttcagatatgtggggccctgttgaaaccctcctgcattttcactgctgctagtaatttagttcctgaagggtctatgtgcccaaatgaaattggaagtagctttatttattttagattaatttaagaatagtgctatctgctaccccttggtcaaaatgagtcaagtcattcttgacattgttagtttttagctctatttaataaaataatgtattagggctcagaaatccaacttgattcagcttgagggaataaaggattttattggaaagctactcaggtcactcctatagttcacaggagggctggtgtggtaggcagaatactaagaatggcccccgcagtattccttgtcccctagtgcccagcctctgtaatgtgatgagatatcactgccctgattctgttgtgttacatggagtggtggatcttaaaaagggggattatccaggtgggccgaatctaatcacacaggatctgaaagcgcagaactttcttcacctggttgaagcagagaaagtcctagatattcaaagagagagagggatttgacatgctcttgctggcgtgacaatggaggggctcacgagaaggatcgggcagctcctagaagcagaaagtggatcacagccagcagccagcaaggagtcagagacatcagctgtacagctgcaaggaactgaattctgcctgccacctgaatgagctcagaaggcgatcttttcccccagcgtatctggttgagagcacagacatgtggggactaacaccttgattttggccttgtgataccctgagcatagaacccagctgaggggtggagcagttgtgtgcagtcctaggattggggttatgcacctgaccaaggtctatcccgatgataggcagccccccaccgtaagctcatatgcagccccaaaagaagggaatgcagttctgggaagataatataataaatgcttgctaaaagtcatactgcatctcatgttgctaaaatgcatgtttttcacattttatgactctgaaatgggggtgcatctttccaaagcatggtgacttctgaaagaaagctgctggccagggtctgccatgtttgtctctgcctatgcttgggcagccttggcagctgttcctggtggctcctctcaactgtaacccctagggtttcagtcagcaaaccactgaacggccatttgaggaaagattctaagtctagttattgtctgaaaaccttctgttgacatttcctggtaagattgagaaagtgctagtatcaaaacttgcagaacgcttgttggcggctgcagcagctatgctcttgagtgacagagaagatgatattttgtgtgagaaacacaaacatcgataaactctgagttgaaaattgattctgaaaagtcaggcagtgagtgggagaagttttgggaatgctttattccatgtatttcacctatgtatatttttatgaatgcacacaagtgataaaagtctgtgtctacattaatccaaaagagctattttaataagtataaaataaaaatgccaagtgattggaaagcattgtgtggcagtttaattgctttgtttttctcagtgttacataaaatcatgctgtattaaaatcaacggcacattagattcatataattttaaataaaacattttagtatattacacattggttatcttgtaagatagggatattttacttggaaaagtggagactggggttttggcattgtgatgggctgcaaaaattggtgtcttttaaaattcagaattgctgaggtgtctgttgattagactgtaagagaaaggactgaatgcttgatgcaggttgaaattgtgccaatcatgtgtcccagcctccatgctccacaaacatttactgccactctctgccacctgagatgcctctgggctctcacctggaatctgtgattaaacatgagttggttgggaggtgaggcattgagaccatgagtggttggggtaggtgtccttggaatttataacatggctttgctttgtttctggcccaaggtggtattctgctgtcacagaaagaacacaccagaccacattttcatggcatctttaccattacctagctgtgagactttgatctcaatatttacctgctttggcagtctctatttctgcattaatgtaacaaaagagctaaactatagtgcctcaaattttgtttctagcactaatattttgttttcaaaaaatgtgctcagtgtctcccttgttgcatttctttgacttctcatttctggtatacatttgttcgtatttttggagttcctgtggcttgctgagccctatgctgagttatgcatgggagaaaagctgaagatggtatccttatcctcagggagctcttccatggcatttcagagagaggatagatatctgaaaatgggagtatgtctttatttttaatatagcatgaaaaaagaaagtttattagttatctattgcaatgtaatacattactacaaaacctagtagcttaaaccaatttatatttattatctcctaatttctatgggcaagggatttagtagcaacttagataagtggttctagctcagggtctctaaagaaattgtagtcaagatatattgtcaggactgcagtcacctgaaggcttgactggagctagaggatatgcttccaaaatggctgacttgcacaaatgtttgcaggaactctcacttccttttgaaaatgggagtatttcaaagaccatgtgagtaagtagatagcagaatgaactgtgtggattattaggaaatacagtcttctggagagggttttgttttgtttagcagagaacaagctggaggatgagggttaaatggtctgtgaacttaaataaatcagcagcgcttattgtgtttgtctattggggtctctgaattgcctctcatttgtcctcattctgggcattcaaatggggctggtgtcagctacaaaacacataaggacctgtaggcaccgttttttgctctgggcttaaacacctctgaaactcaaaatgggaattggatgtctgagccccctttattctaccaccatcactgtacaagtgtggtccctgccatagctagttcagggtcctctaatgcccgtagtctttctctgtcctgaggtcatcatggggcccaggctgcttctacctggttgctctgtcgttctttaactggtcattcttgtctttgtggccaaagctggcttaccagcacagcatttgtgctgtatttcatgggaagaagggaggcagcatgaagcacagccagcttcctttttaaggatatgacatcaacttgcacacagcacttcactgatattccattagcttgatcttagtcacatggcttcacccagctgcaagggtagctgggagatgtagtctctaactgggctaccgtggacttttccccatgaagaagtgtgcaaggaggcagttacttgtctgccacaactgctaccactgaaatctttgctttgtttgccttcttttacactaagcaatgagttccttgcaactagcatttatacttttttaatggtcacagtgtttataatagaacttagttcatggtagatacttaagaagtgtttgctaaatgagggaaacaatccatgaatgagcgaagaaatgcactgatgatggcacacactatttggggcccttctttcttgtatcctaagaaatagtctttgtatttgagtacatttagctgaaccgttagtgggctatgctgagttcaacctgtaagaggatgcttggcttcatctgccatgtggtctttgaacccaggactggggagatgaaggaatatttcattaatccttgcaccatttagtctccttatcaaatggcccaggcctattctttgttacagacaacaatgaagggtgcctttaagaaatctccagtgagtaccgaggcattgcagattaggtcagtagaactgctgctaggttgagcatgatggatgagcaggagaatgagtttctgctgcacggtattgtgaaatcttttcattgtcaccaacgggcctatgaggaactgatgaatgagggagcaagtgtcagaaacgcccttccttgccccagtacagttttaatatctccctgagctacaggatgagtattgataaaagtaaagtttaaaaatagccacggagtgatgggtagccatgatttaaggagaacagcaatggggttagagagggttcattttcttgaaagtgcatgagcgggagagagtgagaggaggagagaagcaggagagctggactgtgaggggaaagagcaggaggcttttataagaagctaatgtgatgaggatgacgagggctttgatggatgagttagctccatctggtcgcagtatatgtaataaatagctgtgctcgggtttgacctctcccttaccagacacatctttctctttggggatatccaggagggagcttccattagagtaaagaacccgtcatgagccagagctgaggatgtttatgggcttgtgcagagggcaaaaaggagatggtatccaagttacaggtttataaactgaaaactgtagcctgtgcgccttgctgacgatggtgctggtgacagaaatgcatttccagggttacactgctacttatgtgaggaggagaaggatgggaggaggagggtggctgaggggtggccagcagccccaagggctgcttcaggtacatcctggtttcttgcttattgcataaacagggcgcctttgtcacaccttccctttgctgtgagcaaatgttaaattaagctggaattgaataggtctgtaactaggtatataattcttaactgggatggtttgggaatgcggtattccggtcaattcaattttccggttaccttgttagaaacattataaaatgtgtttgctcatattcctgccttagaaaattcacaagagtgaattgatcattgcaggcatttgtgttggttttggcatatcattttacacatcagtgattgttgccttcccctgaagatataaaatgtgtcctggcctggagcatcccctaagagttcaggttgaaaaaaaacctgcccactttctctaataagtgtagagttttgatttttaataattttttggataattgatgttttatggatttctattcaagaaatgaaggaaaagggaatagaatttgctactgggttgtatagctgagagtaagtttggagagtgtattagtccgttttcacattgctgataaagacatacccgagactcggtaatttataaagaaaaagaggtttaatggactcacagttccacatggctggggaggcctcacaatcgtggcagaaggtggaaggctgaaggtgaaaggcacatcgtacatggtggcagatgagagaaatgagaaccaagtgaaaggggtttccccatatacaaccatcagatctcgtgagacttactaccgcgagaacagtatgggagaagctgccctcatgatttaattatctcccaccgggtctctcccacaacacatggtaattatggaagctacaattcaagatgagatttgggtggagacacagccaaaccatatcagagagcaaatggatccgccttaagagtaagtggcagatctgagaaatcagcttgtttgtttctttgggatcaaaaggctcttagagaaaacctagttagaaggtcctcccgccccatttccccagtcttcatggaggagctgcttggatgccaggaccaggtccctggtgcagcaagcctgctgcaacattgccaagtgtgggagagggaccgggttttgggcagcaccaccttggccttcctccttcttgtgtgagaagctagggatgaatgtgtgaaagcttggagcctagcataccacatgtataagtcagagccatcagtccctactgtggtgactcatccccttcaagaatcagatcaaagctgtggactcttcatactggaagcaaagcacacatatgcacatgtgcgcgcacgtgcatgcacacacacacacacacacatacttctgtatataataacttcaaggggggtttgctgccaccctttgaattccttacaatattgagaactcagctaagtagtttagaaggcctctacgatatatatgtgtttgtgtgtgtttatatacacatatgtgtatgcattactgtacctatatgcacacacctacatatatatcacatatatgtatatatttgcttatctatgtgaatgactaatatcatccaactggcatccaactggttgatgctcagtattcagtatcaaaggaatcccaagaccctgtgtgcttatgagcatttcatttgttacatgtgcaatttaaaaacatttggtgcttctgtctagtttgaatgttacttataagctgtggcagaaattctccttttgcaaaaaatataagtggattaaggctactcaagtgggaccatccagtagaattctaacacaggtttagtttgtctttgctacattctgtcatcttcttccttctttcctaccctctgctactctggttcctaaatgcccccctcctggccagtgccctctctccacatcgtgtccacatgttgcttcatcttctctttagaactccagtttctgtttcataatcttagctatgtgagtggctattagctggatattgggaggaaatcagagctctagagctaattcatactaaagtgtgaataactgattacttcaaattccccatggataggcatatttagaagaggatatgtcttaacccaaatcaatctcaatctactgaatttgatcattgcggcaaaggaagaattttaagcagcaatgtttaaaaacaacaacaaaaaacccacaaatggctgcaggaaagaaaagagcttaggagacaaaggatgataaatgtgagtattgttcttcatgagagaatcacttggaaaggtttgaaggcagaaaccaacctcaggcactagggacagaaaagggagaaaactttatatgcagaatttcaccatccttctaactggaggtttccatgattgggaagaaattgattttaatcctttaatccttttttgttgattttttaaatttttatttatttattttagagatagagtctcactctgttgcccaggctggagtacagtggcatgatctcggctcactgcaacctctgtctccagggttcaagtgattcttctgcctcagcctcctgagtagctggaacttcaggcatgtgccaccacgcctggctaattttttttgtatttttagtagagactgggtttcaccgtgttagccaggatggtgtggatctcctgacctcgtgatccacctgcctcagcctcccgaagtgctgggataacaggtgtgagccaccacacccggcctggttttaatccaattttaagagataaacctagtctctaacctgaaaaggcccatctttctatcctagggacagatttgtcaaatctttgatagattttaggtgtttctgttgtgtaagaggatacctgatgggaaggaatactggagctcatatgaacaaagaaaagttgtaaatctctggaactctctctcccatatcttttctcttatgaaaataataaatgcttttccaagagaaagcagagagaagaaaaatatttctaatactcttgccagcctgcaaattaaaacactcttaatattttgatgtatttccttccagtattctactttttacatatagggtattttatatgctgcctcttgattttatagcacctgcattttccatataattacatattcctaatgaaaagtactttaatgactacctaatattctcgtagcaaggtgttgttttgttttactattattcaattcacaggtacatgtgttcccccacgggggttttggtttctttagtctaaagctctagaagtagaaataccaggttagagtatgaacatgtttgttgaagggtctctgagacctattgccacatcactttggcaagaggttattgcagtttactctgctattggagtgaagcctgaagcatcgactttgaaagacatcagagctcctacttctcagtcgaggggtatagtaagtcatccttgaaagtggaaaagagaaaaagatggggaaacggggactggggctgcttcataacagcccatcaggtgagtgctgactttaacactaatgctttcctctaaagttgcattaatttgctgggaaaccataacaaagtactgcacgttggatagcttgaacaacagaaatttactatcttacagttcaggaggctagaagcccgaattcaagatgtcagtcgggttacttccttctaggctgtgaaggagagtctgttccaggtctctctcctggcttctggtggtggctggcaatctttggcattccttggcttggagaatcatcaccctgatctctgcctccatcttcacctggcatctccccgtgtgcatgtctgtatccaaatctccccttggtgtaaggacatcagtcatattggattagaggcctgccctactccattatcatttcatcgtattacatctgcaatggccctaatttcaaataaggttacattctgaggtaccaggggttaggacttcaatacatgaatttcagggagacatgattccactcataacaaaagagacccactaggcactagggagtgagctactgcagagtggccccacaagcaagtcacttgtttctctgggcctggctttctgcctctcaaaaatgagggtgttggactagagcagtggcttgcaaagtggggtccccagcccagcagcatcagcatcacctgggaatgtgttagaaatgcacattctcaggccttaacttagcattactggatcacaaactctttggtgggggctcagcagttttgtgttttatcaagccctccaggtggttctggtgctgactgaagtttgagacctactggaccagatgaccctctgggtaagaattctgaaatgtcaacatctgaaacatgtgtgcacaggagttcactgccccatgcacatggcctgccatgagggatgcaagcctagtaaatgatcgcagccaattttttaaacgtaaatgataatctagtttttgtcctaggtgagtggctatgtgacaaactccaaagtttttacaagtccctactgttctttcagtgtgcaacctgtacctccagaaaaatacattcactcaaagtaatgtttattgatcaatgaactgtaccagaccctggacgctattccttttgcataagtgtgacttgtttttgctaagctttaacttgtcccctgtttatttctctttcctaaggcataagtcaaggccagcgagatggcttggcccacggacctagatttagaaacatcctgttattgatgtatggattatacatgaaggcctaatggagactgctgtggggttcagggaagaccaattagggaattaattcattagagcccagcatacatgttgctatatctatttacttatttaggttaatgtcttttgctgatcttcttacagccataagtccctgtcaatagttgataatgtacttgaatttccttcagactattaaaattttacatattggacatttatgacaggaaccaaagtttactttttgctttgacatcctgatatctagggtcttctgtatagtaataaagtaatccaagaatctgagccacacactggccaatcagttttctctgcatctgagatcaccaaatacacttcttttctagccattttacctgtatgaatgtgttggtaaccttgttataggacaaagctgtacatagaatattgcttatctcattcccgtatcatcaactgcaggataacatctgctttgtttctttccttcgttccctggtaagacaccttatttgcctctcattcttcatgattgtgttttgtcccttaatttttgatacaataaccaggggtccttgttgtcatgatgcccatgcagtctatgcaaaagaaagattattttagtgggaagatcatagatgtgggtggcagggagcttgggttccaacctccacttgttgactaacttggtgaatctgggaaggttacatcttcctctcttctttcaatctgagttgtgaggtggaatgagacctgttgtacctgcttttgagtgagggcaaaagagatgcaaaaatgaaattgtggagatggcagtgctttgaacaatacaaagtggtgcactgatgccaggaattctatgcatatccacacacatttgaaatttttgtccagttcagattaaagacaactttattattaccattaaatctgcttacagagcaaatatgcaaatatgtgtgtgcttaatggtggcaggcttgctttaatccttcttgctttggggttctgcattttattttctggtgatgcagacctggtaatgatcactactgatatttaccacattttattaatgtgatttttatgatcctgcaggagataattaggattgggtttgtttttttcacgttcatattatgaaatttcgagctacatagtgacatggtggggaggagggaaatagcacagagaaggaatgcgttacaaataaactcaacccagaaaccatgtttaacatggattaaaatgaatgtagccctgtgttcattatttatagctattatgcagaaaatatgttactggactctcaagaattggatgttaagaaatgtttggttcctccctttggaaagcatccaattaacacaccatccagaggagacagattggggggtcaaggtagacaggaaacattttctttgatttacttattttaaaacctttatttaatttctaccatttaataaaatcagacattagatgaattgaactaataaactgtctttatatcaatatgagagtgaatttgaggccaggctctgttggcatagccttatgttttgtttccttttaaaatctgttcttagactagtaggtttaagcaaagttttatacataagatgatcaaactggtggaattaggaggacagttctatgaccataaagcagatctctgcagaaggcgttacccccgtacatgcacagagaaggttctcagtaaactctcatgtatagaggctagataggatcttggttaagagtgcctgatccggagccagaagacatgcgtttgaagcctagtggttttgtttgtttgtttgtttttgttgttgttgttttgagatggggtctcactctgtcacccaggccggaatgcagtggtacaatctcggctcactgcaacctccaactctcaggttcaaacaattctacctcagcctcccaagtagctgggattacaggtgtgtgccaccacacctggctaatttttgtattttttggtggagatggggtttcgccatgttggcgaggctggtcttgaactcctgatctcaagtgatccactcaactcggcctcccaaagtgctgggattacaggtgtgagccactacacccagcctgaagcctagttttaacatgaactatttggcacccttaagcaagttactttagcctctttaagcctcagtttcctcatctgtaaaatggagaaaacaatagcacctaactctaagggctatagaaagaagtgaggcactgcagcatctgaagtatttggcacctggtacctaacaagctgtcaaatattaattattgttgcttatattactatactgttacaataattattagtaatcttactgagtaacaaacattacctgttgcataaactaggtaggggcagtgtggcagggaataagacaagtaaagagtttggattcataaccatttgaaatcaattctaaattatgagaatgtatctttagaaatatattttatgtttatggagcatgactagtttagaactgacatttaggacttctaaactttgtaaatgaggtatgcttagatgaatggcatcccaattccatgagtgggctctttacttctccgcactccactagtgaatttgaaggccactgtgaaaagaaaaaaaaaccaaaactctacttgttgggctctgtggtgctgttatggcttggcccggctcagtttcctttctcttcttttctggacaatttcaggaccatggcatcttgacttctctaaaaatatttatttagtaagtctttaggtaacttcaaactctagtcttgggcttagtgaaacagaaatccagaatcctagatttctccaaagtgagggtttgtggctgttgtacctgagctatggtgcccaatcatctgtcatccctggctccttgacactgggtttatacacattatagggaggcaatggagtgaagctcagtgaagcccaaacatcagccattcatgtagcaaccttttctgcttttgctgtattgcttcataccacctgtacccttatctccttaatatcttctgcaattctaatctagcatatcattgcttattaccttgtcttggcctaagaaataagatctggaaaatcccagggtgcaatgctagtttcatgtcttcctatcatccactaaagtagctacataattgtgaaaatttaaatgtttatctgtgtatcagcaaaagagcccttgtgtcccactgatgggatatatatattccatgttttgggagatgtgggtggacgagagcctgggtgtgaatcccagcatttctgctctctcccgctcactagctttgtgaccttaggcaggtttcttcatgactctgaatgtagtttcttcatctgtaaaatgagggtgaaaatacctcctactttatggtgtgattttgaggattcaacgaacccatacgcggaaagcacctagcaccgtgcttaggaaatggtcatttctgggtggtgggaacagcatgcagcaagtctgctccttggtcctctatcttgctgtcctacccagtacattgttcattccatgaaggcaggggtccttgttattcatcatttgggtaactacacagtgtctggaacctagaaggccctccaaaagttagctaacaaatgagtgaatccattaaattacagttgtcccttggtcacctggcatgggcaacagtgctttaggagcagtggacaaatacttgtggggctgaggggaatgtaggaaagagcagatccttagaagttagagattcttgagttcaaatcatggctctgctatttattggttttgtgaccttgggcaaattaccctgcctttcaggctatgcttaccttgtttatataatggagataatgccctgcgaggctattatgagatcaaacaagatagggaaggtacctccttagcacctggcacccagtagatatacacccaactaatagtatcccttagcatttgcaccccataggaggcaaggctgttgccttcacacagtgtgtgacaaagccagtgagttgttcagatcaggcatatggtagggactttgtaggaggctgagctccctttagactggggtagtcagtacaagtttccttgaggtgttggggtttgccctcgacttgcaggaggagtttcaggttttgtgcggtagagctgagctctccaatccctcgtccctcctttgtggcacttctagattttccagcctcaggcattttcaggtatgtctaattcacttggtctattgctgaactcccaattaaattactgtattctttaattacatagcatcttaaactgtagctttgaatttaattgaactttttcatgctccttgctccctagccaaacaatttgtacaaaaaaaaattgaattaacaatctgacttttttttgcattgattattataacattaagagagtcccaggagtttccaggctgtaaaaacctaaattgtataacattactcacaataacgcatatgttataatcgcaaagaacttacttaaaattcaatccactttggcatcattatcatgtatcaacataataaatgagtccttcagagcatggtaattataatttgataaatcatcagcagaaaattaactggatgtcaaaacattcattggagagggtgatgaatcggggatgattgtggtgatgaattgtgttaatctgcacagtatgaagccagcgaaatggctaagcagcccaagatggatggggcacagaaccggcaaggtcaggacacagagctgggagaggagggaggcggcgggcaggggtgggggaggagctgaggaggggaagaagaaaggaccagcagcttccctgggaggcccacgagttaaccctttccccacatcagtggagacagggccccgtgaagagcctgttcttgagggaggtcaggaggaacctgtaatgtgtcccgttccatttaagacccccttccactccctactactgcctcctgctaactctgtgggtattccttagattaaaggcgaagtgctgagtgaatgatgagaagcctagtaggcctgacagttttgcattaacctaaaaattttctgatggtggtgagggagggggcttgttggctctgcagtgggagtgctcgcagcatctctccacctggtctgtggtcttggtggacagggtcaagcaggctcaaaaggataggcctgtgaatcatgttagtggggagctcttgtgagccccactagagctgtaaggacagagggacccttccggaggagtggctgctcatagaagttgtggggctgatctgtgccccagcagcatggaaaagggaggcatttctcttcctctcaaaaatccacacaagcagctacagttccttggccgggagaccagcccatctttcaccaaggaagttttgcaagggctgtaccatggcaggcttctctctaaagcttcagtcatgagaggaggttctactaagctcttaagttccagagtgatagagggaaggctgcacattctagaatgttccctgtggccttgcatgctcaagtgcctctgtagcattaggggcttgccggatactttctaaaaaacagcattgccagagaatgtgggcaaaatacttatccaattaaactaggagccaccataatgtgcagggataagtcagcttaagggctaaaatctggggaaataagggccaaattgatgaagtggctatcattaaaaactgttgtttttcctctcattcctgtcccactagagattcatacccttaggtatcttttggagggtgaattagagcatggaatatgaaaaaagtgcagcaagtgagtggaaaaattgtttgaacatgaaaacaaacctagaaccttgagggtactatagctgtttatgtggctattgagtttggtaaatttgtaattaggtgagtatgggttttgtttctgttttatactgattgcttttagccctcagcccctcattaaaaataaccattaaacaattaaaaaaaacccttcaacttgggtaatataataaagcccaggcctttaaagaccaatggctttcctaagccacactgacagccactgttggctgttgcaagaaaggacttgtactctctggcttttctctttgcctcttgggtgaatctggtgcttccctagatggttgtctatgttgccttaatatctttaggggaaaatcccacaaagacacttggaggtttgtcctgtggtcatctggctctcagctgcttcttttctttgagtctaaagtctgttttccttgcttgttgctcgattgagcaactacttatgttgtcggtccagtaataataaccttaccaataatgagaatccctttgacatgtatttggcattactgttctcaaagaattttcacatgtgtttaatcatgttaacagccatttttgggttctctttcctcctaagcaaggagacagtttcagtcaaaaattctcccccactggcatgtacacctgatgtgatgggcatactgaggttcagcacagtggagctgagctggtaaagcttctggcttacatcaatttatgttcacaagctcacgcttattatgataattttgccatgtttccttttttcttcttggtacctttcatcagttttgacacctttagaagcatcagcccaatgctttaattttctctttctgaaagaaggatgatgcctttagtagcatcttaaactatgtgtcaaataggcttccctggactttttttaggaaactcaccaccatcagtgacattatttcttgaggaaattgagctctgagtcctcagacccaatatttaaatataatgtcttccaaaagttagcttgtacattgggatggtgatggactggggtgaaactttgctccaatgctgatatcatagacagtatttgggatatctactgtgtttatcaagggctctgtacaaatggaattgtctgagatagacctcaaagattgtgcatgctaccatgagattcaggttgaaagataaaatcaaccttgatcatgtggctggtttgacctttgccacttgatgaccccaagacacatctactttttttgaggtgtccaataggtagctctctggatacttgtatccacttctctctaatcaaacactgatcttccccctagtttcacctttaggggtagtgtgatttgtggaaaaggagtgggctggagactattagattgagctctggcctgaccaacagctagctttggggccttgggcccatctcttctcctgtgtgggccttagtctcctcacccataaaagaaagagatgaaacattcatgggatttcagacctttccatggtgccaccacacaggtgagctgtgatggggactctgagccctttacctccccttaagccccagcacttctacctttatctacttgtatctgcattctgcaaaggatttcatttgggggaaaagttctgctgctcaaacattcttgaaagccaccttcattttctctcccatctagttggtactttaattgcttgggtcccactgtgcatcatggtgctttctagcttgtgcattttatgaggccagcttatgggattgtattctagttgcccaaccctccttctctctcaggtacccctggggaccaaaagttaggagaaagctgggaaacttgttgaagagcttaggaagggttgaagatgggcaggcccagtgtgggcttggaagaggatgggcacagaggaccacatcctttttactgtgtcttcttattcctatccatcctaatctcagctccgtgtgagctgacttgcacaagaagctcttgagtcctaacttccataacatctaaagaagtagtggtaccttctatttgttcagtgtttaaaaatcttgaaaatactttcacagccattgttatattgggtattctaaataacctgagaaggtagaaagggcagtagttgttgccctgggtctagagctggggatgtgaaggcctggaggaggtgaccaatgagccctcctcagtgacagtaaatgtgaaaaccaggacccaggcttttcaatcctggtccaatactattccctttgctcttccatagtgagtggtttctcagcacccctgagtcagtactgccatgtagagatattggtgaaaaggagaagaaattcacattggtctgttttctccttcctttggacatttccttcttccctttctctccccatcaagaaaaatgtcttttgttcttggggtagctatagacagcctccccgtctgctgttttcccttctctcctctcgcagcaggaaaacagggtgattatggggccttctcttagcggaggtgttaagggtttatgtagtgcttgtcaatgaatggctaatggactcagttgggttgtttcaatgacagtttcccacaatctgatactaaagtggaagccttgagtgaagcttttatcactctttcaccaggctcatcaagaacttccttttcctctctggaaattgtatttcatgtggtatatttctaatccaagtgttacatcaatcagcaattcagtgtaggcttgtggttctcctggagcattttacaagcaaggatggggtttcttattctggccctcttggactcttggaaaaacactccaactgcaatttccttccatctattatgatctgtttttttagttgctattagaattattgggtatttcaagacattatcttaataaaggcattcctttctgggctgtgcttgacctgtgggtgagattgggaatctgtttcttctcatggttatagtgaagttagggttctcagaaaacccaacaaaatgggagcctttgaaacatgatctttttggccaacgacttctgtgtggttaaagggttgctggatgtcgtcagcctgtggatttccatctggagagtggtttgtttttaagaaaaccctccaaatgatcagtctttcatatttcagatgtcaaagaaagaaacaagacatttaaaataactaacactagaggaaatattggctggcaagaaagggggagtgagatctggctcttggatgtatcgcttcagctgttttctgaatgtttgacaaacacatggcttcgatgtgctagaatcatagcagcccagggatgatgactaatatggcattagttggttataagtccacttaagaattagcatctgaattcatgagctggtttcagtgaaaggaaagaaggagactttggagtctggattttggagtttgggattttttttttttaatgaatattttttaaagagcgagaaaacctctccttaaccccagggaagactatctagctgacattttcctctatggtgtcccaaggaaaaaacttgtccccaaatcctatcctattcatataaaagactgagattaaaatttgggttattttccccttctcattttaaaaattcatctgaagcgtttttgaaaaacaatacaaaaaacctctctctgcaactgtgacaggatatagcagctgtctgagaattttctctttttttttactgttatcttttctctctttaagaaaagagtcgtttcagaggcagccgtgacagctctgtcatttcactcacacctctaaatttctctttctgttgtcagtcagcagacagcaatctctggattctgatgggcctgagggatgtccaaatacatgagagatcggagagaggcctgcagcagtgtgcgtcagaagccgtcatcttctgcctttattcttagaggaattgtcaggagtttataaagttctcctgtgctgggatctccaagtctcctctgccaccatctacagcccacacaaataggcatgtgaggggctggggctggggctggggcttcctggaatgtcacttctgcaagttccagttaagaggttgtgttgagttcctctaccctgtgtgctacactggggaaattaagactatattgggagtaagtcctttcaggacaaaaccactttaacaacagcagcagcagcagcagcagcagcagcagcagcagcagcagcagcagcagctactcctgtttacgtgttcttatgttctaggcactgtgccaagtgtttcacatccactctccactcattttccagtagtcttgcagtaggtactatttttcatcccattttagtgatgaggcatctgaggctcagattcattaaataactcaagtaacttgcctaaggccatgcagcaagtaagtgacagagctgggattcaaactcaggactatgtgacactgttgcctcaaggccttaagccatgtgcagttctcatatgccatcattgtctttttttccactgtgtaaggagacacagaaatcataatgacctgctggacaggtgaggcctgtgcccttgtccttttttttttttttttgggacggagttttgctcttgtggctcaagctggagtgcaatggcatgatctccactcactgcaacctccacctcctgggttcaagcgattctcctgcctcagcctcccaagtagctgggattacaggcacctgccaccacgcctggctaattttttgtatttttaatagaaacagggtttcaccatgttagccaggctggtctcgaattcctgacctcaggtgatccacccgccttggcctcccaaagtgctgggattacaggtgtgagccatcatgcctggcggccctcatcctttatgcagtattatggcagctgaattaagatgaataatgacagcaccgtgacttgggggcggtggggtagtgggggtcagaagtaccccaggaggtggaggagaaaggccacctgaactcaaagggaaaagttctatagttgaaagcaacctggatttagagtgaatctctacaaaaggggccccaaaatgcctgaccatgtgagcttgatataggtcttttgtggagccaaacttacctattggtctgagctctcctgtcagggcttggcacatagtttgaacaaccccagtagtcgtcttatagatgttggcaaaactacaaacaacacatttttcacttttaaaggggccagttttgcatcttctatctgtggtattccattgtccccagttttcttcttctttcttctgttaatttcccctgcagatatagcatctctgccatccacaaatgtgtcttggttccacctaactgttccctggggcaacatggaggggaggcaaacacaccttgctgagcctgactttgaccatgactcatggtgttcaggcccaaagcattcaggggatgagctacacagcaaagtgggatgctcaacattgctacctccaaaatatcattgttagtcatttcctttctggagttagactgcttgagtgcaaatcctgattctacctcttagtaaacctgtggccatttgggtggttattgaacttctctgtacctttgtttctttgtctgtaaaatgaggatagcagcacctaactcatagggttgctgttattgataatcatgattattgcttttatagccttacactaagggccaggcctattctaagagtttcacattcatgaactcattcaatcctcccagcagctcaatgaggtaagtattgctttttcctcattttgccaatgaggaaactgagttgtagaaaggttaagttatttgccaaaagtcagacaggtagtgagcaatggaacagagattcaaaaggaaggattctatgctcctaactgccatcctgtcccctaaaatttcatacctacaacatgcttggcataatacctggcacatagtgagagtttactaaatatataccatagataataattgcagtattattaacatgatgaggattaatgcaaggcactgtattagctgctgataataatgatgcacaatccccaaaaagttcacttgtgtatttaaaaaccaatgaggaagatggatgctttaatgagcgatgaccaccaagtatgtacaagctatgacagatgatctacagatgctatggaaggaccagcatttctttaaataaaaactactggtaactttcatcttaggtcaggcattgtactaagtcctttgggacggagttattttactgaatcctgcatggtagatgctgtaccataattatcccattctgtagacactgaggactggagaagtaacttgtctaggtcacgcagctctagggggctgaaggccctgggctctaagccactgtcctactgcccaacttgcctgagtgcctctacactgatggttgtttcccaggacttcctgatttttttctgaaggatggaaacaaagacgacccaataggagtgaggtcattacctccctcccattctcccttcagcaccagatctccaggagatggttcagtaaaacagcagtgaattggatagaggaatcgtctctgtggagtgactttccttgtttctttggggtggaccattctgggctttcctcctttacacatgtgctcatgtgacactctttgtggagtgccagggactgtgtccttcgaggacagattgggtaccctgttttctgtggccttccatgaaaactgcccatggcatgctctcctttctttgggccttgaactctgaacgatgcacagaggcacttctgtcacatcttcctttgattctatgttgtgtgtattaggctgctgtgactatctctaaagttcttttagaatagaaatcatgtctgctcaatattctacagcatctgtctcaggctgatgagcatcccaggcctctccaaaatcagagtcattttttctttctttctttccttcaccaccgtttccaattcatcacagagtcctgtcagctctaattctaaaatgtttcctgaatctcttccaccaccaccctgggccaagccaccattacatatttctgggacaacagtagtagcttccaaactgctctcttccttttcttcttttcttcctacaatctatttgccacatggcagccagagtgggcgttcaaattgtcaatcagctcctgtcactctcttgctgaattccctccagcagttacctgttgcacttggtgtaaaatccaaagtccttccatggcctacaaggcctggtctggtctggtcctatcaacgtctcccacttcatccctgcagaactctctctactctgtacatgccaggccccttggccttgtgtggtcactcaaaaagaacaaacctattcattcgttcattcatcttagaatctttaacaagctattccttttgtatacaacattcttggttaagttggtcccttcttatcttttaggtctcaactcaaatattgccttctcgaacactcatataacccacttataactggcagtctctctctattctgttgcttttttgttttcttcagatcacgtattattatcttcacaagtgctgtttattcatttgcctaaatgtgtattgtctgtctacccccagtagagtataaactccatgagccagggccttcacctaccttgttctttcaatcctatgccccctgcacctggcagaggggctgaaccataatgccagctaataactaataagcagttaatatttgtcaaagtattactatttgccaggcattgtcccaagcccttcacatatattaagccatttagtgtttacaatgaccacaggatgtggatattattattattcccattttactgatgaggaaactgaggtatggagggtttatgaatgcagtagctcaagggcatacagctagtaagtggcagagtctggattcaaggctccagagcatgtgttcctaatcgccacattacaatgcctctctagtagatactgaataaacccttgttgggtgaattaatgaatagaagatgctcagtagagctttgttgggtaaacacaatcatggattattgtggaaatgtcttaggcctgaacattgtcaacctccaagagcagagggcatggcactgtctacgtgggtatgaaatgccccataaccgtaaatggggtctgctcacaccacatttgctatttatactttatactagatagagccctctagctcgatggttcttttcttcccttttttttttttttccttttttaaagagaagagaattgtgggaaatattttgttttccctgggagccagactatgtatttacttcaagttttattaaatgagttataaattttcccagcaatttactcatagctcaagaggtttaatttgcatgtgttgccttttacaatatgcttttcgtaatgttgcagatgcttcttccccagcttcagtaaacaacaggcactccgccaggtttttgactgaacatgtgccaggcctgggaaatatgagttaactccatggtgactgttgggggccacacgtccccctctgtccagggcatctggggagctgagtcgaattcctgaggggcaggagcaaagattttctgaatcttctttttggacatctttttaatatttttttccacacgcaaaataaataaataaacagacatttctgcctaagtatcaggtttgcactggtcctaattagaaagtagtgttaataggatgacagaaagcatttgctagggcccccagggtgatctctagagaggctaaagtcactttagcctttggggagctgcccacggcctatgatggtgaagccctttgagcttcgaagaagccagtccctctgagggtccaggtctgatgcctgtttcatttcaggtagagagcctcagggttgagaactcatcttctggtgtcacactgtcgggttgagttctggctctgccacttattagtcgtgtgaccttggacaaggtacttaacctctctgtgcctcagtttccgcatctgtggagataatggtcataatggtccctgtcttgtaagtttgttgggggaattaaatggaatactgcatataaagcgtttggaggagagtggtttataaatggacacataaatggcatgctgattgtcccagggctattcagttcattggctacaacttaggggacagatcctctcagtgagttattcctggttggagatggagggcactggagcaagggatggatggtgtgttcattagaatgaggcttagctgcatgtagcagaagagctcaagttaacagtgacttagcattgtagagatttatttctctcacataaaaggagtatggaagtattgcagggctggtgtgataatttcatggtgtcatgaggaaccctggttccctctctttgtagctctgacattcttagcatattttctcatgattcaagatggcagcttgtgctcttgtcattctgtgcgcattcctccctcaagaagcagggaggaggaaggaacaaacaggagtctcattacctcttaaggaaacttccagcaagtcccacgtaagacattctttgacatctcattggccagagtttagtcacagagccacagctagctgaaaggaaaatggaatcgtttagcttggcagccacatgccaaataaaaatccaggttctgttacaaagcaggaggtggagaatgggtgtggacgcagtgaactatcagtgagtttccagtattgtcctgtggttttgtgacttgaggttgaaggaattcccaggtacataaagcagtattaaattttgtttcctagatgattttaggtggcacaaatacattttttatttgaataatcttataattttttgtatgcaaccatattataattacatatcaaacccaggatttcacagatctcctacagtgtgatacaatgttataatgtttttctttaagtctaaatttaactgcatcaatgtttaaaaaattaagtaaatgccggcatatagagatgagccaggcaatctgtgcagtggctaaatgtgggtcctggggcctgagtttgaatctgtaacctgccacttattggccaaatgaccttggactttccatgcatcactttgcttatctgtaaaatggcattaataatagtacccatctcacagagttgtgataaggaccaaatgggttagtacttataaagctctaagaatagtgccaggcatgtgatgagtagcccgtgaacattagtcattgttcttattgttattatttctgttgttattgttattattatggcttatattactgctattattaataataatgattacaatagatgacatttgaatagagcagaaattacaagggtggtacatgcgtgactgaaattagggaaacactggcttagaggagtgagattggcagttaatcaggagagtcttagacacagctataaataatgactttattaacaattaaaactagtgctttatgtttaaagtggctccatatatgataataacattgattagagtttattgaacatggtgccaggtaccatggggtatgctttaaatatattacttttaatttttccagtgctgtaagctaagtgttctttttattctatagatggagaaacttagtctaggatagggttaagtaattttcccaacatcccgtggggaccagcatcaaggtccctgctgataaacgcatcttgtttatgtcctttttggtgccctttcttcccttttccccttctctgtttggatgtcaaggaccccttcattccactcaggaccctctgatttcccctcctccccatgtttcttcccacaccccaattaccagctagtccatatgtgccagctgtttcccaggtcccttcccactctcagaactgccctgtccatcatctgtgttcctgcaggacacaacaggcaaaagctagtctaatgaactaatctatgaaaatggacattaatagactaatatgtagccctctctgggtcatttattttagaatgggcttgttgacaaggttttgtttttttcttctgaataatttacttttctctctctttcttcttttaatagactttattttttagagtacttatagttcacagcaaaaattgaacagaaggtacagcaacttcccagatacccactgtcctcacactggcatgtcctctctcactctcaacatggacttgaggtcttcactcaaagggataattcgtgatggagattaaaggcagcaaacagttcagtagccttgtgggtctgtcctagaatgtctcctaggttattctttaaggttttttaattgctgtatcataggatcctgacaaaaatgggacactgagatgatgaccaaagggatcaagcacactggtgagtgatcagtcaagggccctgctcccccttctccagcacccagccctgtgtctggcagatggagagcacgcagtcaatactgttgaatacatgaatcgcctaccaggggcccttcggatatgcagggaatggaaggtcctttaaggaatgggacagtgacttacagtgggtaaggtttggttgggcctcgtgaacttgatagatttttttggcaggggggctataatgttctgtcatgcaggtcagcttgctgtcatcctggacccgtgcgtgtctggctaagtgtgaactgaacatgagcagcatgatgcagggattaggggacattcatcttccactctttctctttggagctggaggctcaatgtgttactctcatgatgtcacaaagcaactgatgtcttactacatcctgaaagaattatttcctcttttactcttcttacaaattgtacctcatgatccattgaatttcactttcctatttttccaacatttctcattttctgccctttttatcctctctctcagaccattgggggaaggaagaaatgttgcttagcaaccagaatgaaactagtcaatactgcttctaatattaaccctttggtaacgtgtgtgcgtcccaatccatgtgttatagaactctcccctagcatgttttaaactagaacttcatctaaagttggcagctcaactttatgtcaaatcacaaacatcaaggatatatttgtgggttgttataaatgttagcaagttccagtgttataagttatacacattgtctgcttattaaagtggttcacttttacattcttaacttttgaaatttgctgtgactatttcacatgttactttcactttttgaacaaaatagtttctttgctggcttggtgtgtgtctgtgtgtctgctggtttgctttttagacatttaagtccatttgtctgacaattggaagatatgttttctgggttgtatcattcattcatctaatgtttattgggctctactctctgccaggtgccatgcagggcaccgtggagtattgctgacttgggcaaacactgcagaggttgagcagacttggtttctgtatgcatcttttcatcagcaaagactctttttcccttttcatcttcatctattgaaataacatataacagggtgggttttcagatgcaatagttactcttctactggaatggtttctttggctttgattggacaatattatccatacattttaagctctttgagagtgagtgggccgggcacggtggctcatgcctgtaatcccagcactttgggaggctgaggcgggcagatcacgaggtcaagagatcgagaccatcctggccaacttggtgaaaccccagctctactaaaaatacgaacattagctgggaatggtggtgggcatctgtaatcccaggtactgaggaggctgaggcaggagaatcactcgaacgtgggaagtggaggttgcagtgagccgagaccacaccactgcactccggcctggcgacagagcaagactccatctcaaaaaaaaaaaaaaaaaagtgagtgagtgataggatggaacaaaaagataaatattggccagctcctctttcatacaccaggtacagctggtgcacacacacagttaaagtttgggagtgttgatttgcccgacataaaatcatgttggtgaagttggcctccagtgtttctcttcttacatatgtgcccccctttttgctacaggtgacctgtcaaatctcccctgatatccagcactctcatgccagtgaatgccaccctcaactgggggaaacagtgaactgatctcttcttttccttagggcattttttactttattgaagactctctacaaacacagtgcctttgggggtgaaccagaatttactgtggtactctacacagacagtaggctgagtgaaagctgaactgattggggttttcagattgcctctgtcttctctcacttggaaaggggcgattcccccttacattccctctcacttctggggtgcctagtgggtgatatggttgaccatccttggaccccgcattgccttgcagggtaatgccagttgggttactcacattctctgggtccccagagttcccatacacgagaccattgtggagttgtgggggttgtgtggattccccctgttagcttgagtggccagtattccacaatgcttgggcttggtctctgtgaattggttgggtggcaaaaagtatctacaatgactagattctgtaaagcaagctaaaggtgaagctggccttaatgattttagcttatttgttatctaaaagatagtggtgacctaggactcatcaaggtgtggctttgaactggagtttggtagatgtcttcaaaaaggcatccaaaacacctgagattattattacatggtacttgggttcttgccttactttattcagaacagaaaaggagagagaacttagagacacaggaccgggcatgagcttaattctagcagcttctattgttgagcacccactatgtggcaggcattgttctagacaggtctattgcatacgttatcttccagcctttccagcagcctcgcaaggagcacattcatatccctgttttgtgggtgaaaaaactgggattcaagagagggtaaatatcttgctcaaggtcacatagcccacatggaccaggcagggatgtaaatgtagatagggtctgactctgcatcctgtgcattctctgcaggaccacattgcctcctttgcaagtcaacctccacttgaaggcaggggggagctcgggttgtagtaaacaatcctagatgtgagtaatgtgggcatccagccatcgaagcctgccaggacagtttttaccatgtgaaagcacttagttgttcagtaggtcccattgatcagctaaaaccatagcaggaacaaggaaagggctacaggagccaaataaaaatttcacattcactaacttggaaagtctttcttcatttctcatttactgcattgctgtatatctttccatctcttctctcgaaacatgatcccagtttactttgaagtggctgagtgtggcgggggttctgtgagggagaggtgattctgacgatgatgatggtcttacctgtcattgaatccttcacatatatgtgtgtatatatgtatacacatgcatacgtaatatccccaagtcattttcatttttccttcattagctctcacttacaagttatacattttcaaatataatatgcgtctatgtatgtgaataggtatgtgtatatgtgtgcatatacatacgcgtacatgtacgtctccaatgcttttcttttctttttgatacagagtcttgctctgtcgcccaggctggagtgcagtggcacaatcttggctaactgcaacctctgcctccccagttctagcgattctcatgtctcagcctcctcagtaggtgggattacaggcatccaccaccatgcctggttaatttttgtatttttagtagagatggggtttcacgatgttggtcaggttggtctcaaactcctgacctcaagtggtccacctgccttggcctcccaaagtgctgggattacaggtgtgagttaccacgcccggcccccagtgtgtttttatttgtcctgagtttcctttcctcctcacaatgctgctccccatgcagggagccggccaggcagctctagggcagggggagtgaacagggaaggaactagccgtgcaccacaaggtcgtgtgagaatgtcagtgtctgggcatatcacatggcaagtctttccttcaacgacatcatgatttacctgggttcttgctgagctaatctccctgcagcaagaggacactaagtactggccgtatggctggagaaagctgccctgggtcctgcaaggccaggctgcctggaattcttggggatctgtgccctgcggggaggatatccaaaccagcaggtggaggaggagaaagagacaagagctcaggcctacgcagagcttccctgctggggcctggtctgctgagtgggaaggaacagtcaaggccatggagccgtcaacttctctgccctgtgtcctcctggaagggaaagggaaggcctgccagggcctgcagagacaagcagccatgtggctggtcacggtccaagggaacgtgtcccactcacagggcctaaagcgggaagaacacctccttcatgctgcatgagcaggagcagatagtgtttacctcttttgtccgtggccctgtgtgggggaccaagggaccgcatcatcctacataagatcagcgcatgtcacagccaggcagagggctcacgtggcatgccaaccaaattgccctttcattggcaatgctgaaagtgaaggccatgattctcaattcctggggatgcgttttgcattttgaaactcagatttcaggaggagctgctgcatttttctgttcaaacccccagtctgagagaagtgggctcaagaacgtaagctgttggactcttcctcaccctctgctcaaaaggcattcttaatgagcctcaattcagaaaatgaagtgtccaagtccaaggcctgaaaacctgatgcattatagtaggatgaatattttgtctaattatttgtattaatacaacagcagcctaggtacataggctttatatgaacttatctgtggctgaactccttgtctcccagatgaggagagcctagatagtggtcttttgtgagaaatggcttgttggagggagcgggtgtgagcagttagcagaacttctcatatttatttttttctgactttgagggagaattctgagaaacgatggaaatgggaaaggaagtgagtaggaaaagtaaagggaaatgtataaaaatgaaggagagaaagtaaataagaggaagtattagagataccaaccatggcatccagcgttttccatgttctgttaatcagaatctcagcttaaattagcataagcaaaaaggaaatttattagttcacatgtctgagaaactgaggagtggataagactccaggcctgactagagccacaggctcaaataacacagttgctgccatctctctcctgccacctcacagctctacttccctgctgctgacacccaggtaaacttcccctaagggaggcaacgtggctgtgaactccacaaggctttcatattctcttctcatcaacctcagtcaaaaaagagagatttcctctcaccagcagttccacaagatcccagactgggtcttccagtccctgattgggccacatacccaccaacctcagcagtctgtgagagatgacaccctggttggccagtcagtttctgtgcctgcctggagcctaggtggagttggctccacagaactcagagatggagggaggtgggaggagtttccctggggcacatcagggtacttgtacaggaggatgtgaatgcacactgggcaggaaaagacccgccaaaggaagatgcgatgaagcgaaaaggggtcctggagaagagctgttgatgtgatggttcaatgaagatggagaaacaaggaaaatcaaacctgtgcattgctttgggtggccagactggatgataaagccaacatggtagaaaggctcttgtatcaacaggagttggtcaagatgttttctagacagcattttaaattcagagcatcccttttattgtaggctttagaatgaaggaatgtggttgtttgggcctatggatcttaaccattgctagaacctattattttggagagctctgagagttagtgaggagagagtcatgagctggaataaacatgttttgagtacctactatttaacagacaccagtggtttaaagatcaataagatatggtttctgccttctggcggaggtatgggtaatataacaactacaatctcgtgaaactctcatattctctgatgaaaaggaaatattttcttcctccaggactaagttactcaggctgtgcttcctggaataccaggattgacttaggtgtttcgtgggaaaacaaaaacagaaacaacaatttgtgtcttgacagattaaaagatgttgtaccttctttccactgggggagggaggattggcatttgcaatgctcgttgtcatatgaatggctccaagaagtttggcaataatgaaagcttttagatgttgtttaacctggcattacaactagcttatgtgatgatggtgtacttctttcatgacactagtatagtattgaacatggttcataaaacagagcccacagaattagccacatcttcatggatttgcacatgcagagccatctggaaagacctgttacccagtctagtcttggatgttgtaagggacctattgagtgtttccccaggcctaggccacgcttctcaccacacccagcttcctgagaggtttataacgcagatcagataacaccagcttctcctgtcttttgcctctttgggttttctcctcaagaactagtcacagtaattctgttctttggagtctgggaagactgactgagattcactttactggtatcatcatctactggtggtacccaagatgattttggaggtgcatagctacatcattaattgtgtgaagaaatgctttttccctctcagttctcctttctgtccttttggccacaatgaggagaaagtcttagtttggagctgctgtgtctttaatgtttctattacgtgtggatttttttttttaagagagcagccctcaggctcaaagccttcagtaggtcactatgtctgaactacatttttaaattattttgttttcactgtacatatttctctgaatactttttacttatgactgtaggcaccttctgcttatgacagatgatcctggtctttatgatagttgtataaaattccctttaaaaataaatataaggaggagtgggtcaacttagatcaaggtttcttaatcttggcactaatgatattttgaaccagataattctttgttgtggagagttatcctgagcactgcaggttacttatcagtgtccctggcttctacccagcagaagctgcccccaccaaagttgtgacaacacagaacatttccagacataagtatccctatagcatgaatgccccaagtagtgtaaaccaccagtttaaagcagagtgatatagaagtgtagcaatagttgtgaaggtcgtgtggatgaccagatttgaatcctgtattatggttagtgggctggactgccactggctgccataagagctgggcaccttcaccccaccccatcaccctctccacttcgaagtctttccagatggctctgtgtgggcaaatcagtgaaaatctgtggtctctgtgggttgttggtaagagaatgagctttggaccctgttgcatttggggctgtccattcttttgcagaagcagcagaagtccagggagggagcactgggcagcccagccccatgacaaatgccaagtcaccagaaatcaaaagaggaatgctgagtcataatttccttcattcaggaattagcatgtgcttttgagattttgaactacagtgcaatgcagagctggtgaatgagcaaggtttaaatattcatttggcattagcatctgtgaggatggccagatactttcattaattggattcaggttatatgtgtttcgtttaaaagcagctgcgatcactaatggaatgacctctgtgtcactttccattctgaagcaggaggcacgatagctcctcttaggatgttgtgtttgccacttgcgctgacaccaaatgctggtaaaatatggttgctccccgctttaaaaacaaaattttgttttcatttttaataaagagacagatcccaggcttgaaaggcatgggacactgggcagctatactgatggctgcaaaggtgtgggatttgggagaagtcagttttctctttcctatccaccacccttcttcctccctccagcctccaccaccttgaaggccgtgagtccgaacaggggacccagagacaggtctgggtgtccaggtggttccccattctacattcagcatggggctcacctgccacccactcttgcctccatgtcccacccccaacatgcacacatgcctctctaggcttaattttgagcatttagaaaaacataagaccacccccacccccagctctcttttcatttctccctttcccaccaagattcacgcagaccggaacagagtctttcaatgacaatatactattatgttagtataataataatacatttgtttgctcttattcctagcagagcagccacggagtgctctgttaaaatgttagatgagaccctgttactcctctgctaagaaatctcctgaaggcccaagtgctcccaaggcccaggagaccttgccctccccttggcccctgacctctgccctcaagcctcctccctggccctggctccctccatgccagtgggtgcggcctgtccttgcagctcctcggacctattggatgtctttttccttgatgttccttctatttctatttcagtatctctttcttcctttgcatctttgcttaaaagatgtgtcctttgcacagtcttccctgttgagaatgaccccttctcccaccccagctacctctgcttcttgctttctctctacagcctcagagtcctccacgacactctgcagccctcatttcccatgcaggttgcatgccttccattgcgggaatccaactccacaagggctggggtcccatccgttgtagtcattggggtatccctggcatctgacacacagggatgctcaataaatgttggtgagtaaatgactgactgttactatgactgtattagtccatgctaattgcattgctataaagaaatgcctgagattgggtaatttataaagaggattaatggttctgcaggctgcacaggaagtgtactggcttctgcttctggggagacctcaggaagcttttactcatggccgaaggcaaagagggcgctggcacttcatgtggctggaggaggagggagagaagggggaggtgccacacatgtttaaacaaccagatctcacaagaattaattatcaaccacagctccaaaggggatggtgttaaaccatgagaaaccacccccatgatccagtcacctcccaccaggcccatctccaatgttggggatcacaatttgacacgagattttgtggggacacagatccaaactgtatcaatgactgatagtaacagcagcagagggtgtcatgggttacagagtgcctctgtgtgcattttcttgctttcctcaccacaaccccatgaggtaggctaggaaggttttattatcccactttgcagatgagaaaggtgaagcccaaagatagccaggggtctgttcaagttcaaacagctagcaacagtgaacttgaacttatttcttctgtcccctgggctgtttatctttgatatctgacatggctgattcaggcttctagaattctagggcagctgcaggtgaccccagtaggctgaagttaggagacctaggtaaacgagtgtcatggtgaaatcccccccgctcctgagaccccacaggctcctcccagacaggccggcctccttaggccttgggtataattagcctagaggtctccggccttgatacaataactggtaagaagctatccattctgccgttcattaagacaggtgacacaagatgaaatattttaggtaaatcatctggcctaatttagaaaggctctgtagggctagagcctttgatttatcggggagaggtatctgttatcagagcgtctcacacacggacttatttattatccagaatctgtttttaatttcagagattgtttacctaaactgctgcgtgtcagattccaggatggatttctgcttagcatttaattttagatacttgccatggtggacagaaaaaaatgggcctccagaatttgtagtttcattatgaatcttacccttggcagcccctaccagtagtttgtctttgaaatctccttggtacttgttaaccctgctctgctgtgaaagagatatggtttatttattggactttgcccatttatgaaaaagtacagaaattattaatggtttagtagctattaatgcattacttgggtggaattcaaattctaatatttatggtaaacccctttataatgaaacgggcagagaatcagctctcttgctccttaaatttggaaggctctggatgccattggaatggctccctgtgaaatatgagcccttctggcattatatttacacccataaataaaaaataagtactttgggttggaggagaaataattaagaatatttgtgtagataataaagaggaaatggtccagtttggttaagtgtgtgtttaggaaatgccaggggctgctgggactcgaatgagggatgggaaagatcagggctggaggactgtgggtgtggaggacttctggggacttgcaggaagggaagccttgtggaggccatcgtgggaccatagtaagatgtgtggatctgggaggcttgtttggattccaagtcttccctaagttagtacagctctttgatagcagttgaacttccctggacctcagcctcctcctccataaagtgaaggtgatatctcacaaaattgtcaagatggtaaacagtgtagacttagaattgtaataaataatctacagatctctgtatatgaggcctaaagagagaactcgggtatggcaagcatctcagagcaggattggaaaatacatatacatatgtatgtacatatacacacatatagagatacatgtatttttggtgtgtgtgcataattgctggctgtcgagtggaagatagggaatatagaatgggtatgaaatgaccttaatatggacattttaaaaaatacggtctcagaatacaataaaatgcattgagtacctcttacccaccagggctcttctgcccgtggaatctgttattgggttaatgttccctgatctttttctagtccaactgagcttctttctgacctcttcctgttagaagctaaagggtttggttgaatctctacatctgtaagcatctggtaatcagctgtaaaatcaacatgtcataacaggaaggaatctcaaggagcatcttgtttagggatggcaaatacattttattgcatatgaaagctatatagtggtggcttctagaagtgctgaattgagaaaaattctgacccatagccgtgtttagcaggaaagatgcgtgactgatgagtggtacctactagagttgatgagtgggaagtagtgatgttgtgtctcacatcctctcatagtttttgtttgtttgtttgttttaagaaggaaactaaaacctagcacagtcaactggccaagctcacagagttaaatctctggcttccaattcaagtgatactgaggccacaccacactggtgtggttactacagacctcctaggaggacagcagtcagctgcccctgacttaacagagtaccacttcaagtggacatagtgtttgacatctccttgacgtgtctgatggccttcacagagagccaagaagccaaggcccaagagactatttggatcgatgatgattgtgttaatgataacccatttatttagtatttctatgtccctggtcctataccatgcctttgatgcttgttttctcatttaattacaacaatcttatcagtgggtgacaatctcttcattatgcacatgaggaaaaaggggtccagataggttaaactctgcagagtcacaagctagcaagtctcaaagtctcacagactccagagcatgtgtttttaatcactggacatctcctttgtgcttgtgaatggtgccatccctagaggtagcatagatgcatcctccgagtaccatgaagaaagatgtacatgtaaagtagcaaaggaagctggggtcagtgggtggtcgatgctcctgacagacaacatttaggcgtcggggaagaatgtccttgccatctcatacagagtttccctatttctgtgtgtgctgccgtgactccagcaagagttggatggaattggggagatcaagtctccagttctttatttctgctccctgtagctaattgcataatgactcataaaagttaaatttctggtgagcatgtctgccatgctgttttgctaacgggcatggacgtttcctgacttcagaagaaaatgagccctgatgctggagaaagggacaacctttccccctaacaaattttgcctctcttgtccctaagttatgaggagcctgagtagacagtctcattctgggagctctgggctcctccccatggtgctccaggggctggtggctggcttgcattgagcctgtttactgtgtggtgaaggcagaagacctggtcattgtattcctaattttacctgagttaactatagccagataacacaggtcttggactcaggtccaaattcattcatccaccaggcttatcctttgtctgcctattggcttttaaatattcaggttacagggtataatcttaacatttaggttaactgtcaaataaaaataaaaataaaaataaaaatgaaaattaataaggtggaaaaaaagaagagagtgtctttatttacaacttttattggagctggtggaagggctccctctcagcccttgtgattcctgtctagaaaatgggctcttctctgcatggtgcagtcagcaaactactggtctcctcctgggctgggtgtgggttgctgccctgcctgggtcacatagaaggaagctcaggaaattctttgatccaaagctacttttctgtcctaggaaaggggtcccagaaggatttcacttctccccaagatagcaatgagaattgctctcattgctgctgatgatgatggaggaggaggaggaggatactatgttagcatttgagtagaatcatcataacctggcaggcattgttctaagtaattaacataattcttcaatagacttgaagttgctgttattgttatccccattttgcagttaaacaatagcttggcccgcttggtggctcacatctgtaatcccagcactttgggaggctgaggctggcagatcacttgaggtcagcagttcaagaccagcctggccaatgtggcaaaactccatctctactaaaaatacaaaacttagccaggcgtgatggtgggtgcctgtaatcccagctacttgagaggctgaggcaggagagtctcttgaacccaggaggcagaggttccagcaagctgagatcatgccactgcactccagcctgggtgacagagcgagacttcatctcaaaaaaaaaaaaagaaaccatgactcatttattccctcagggtcatattattggtacgtggtggagctggcctgagaatagagtctgtgcttggtgactggaagagtgtcttaggagaggaacacttccctttccctgtcagtctccagatgcttactctcctcttcttggagattgttttctttttgatcaaaattaaatccagaagagagagggaaaatcctgatggagcatctttgcaggccccttttatcagggcttttctctggcttcatctacctgcctgctccacaggccccaatccctcacctaaacccctaaggcctatctattctttgtctgtcatgaacagttctccaaatctttattcaccctaagttatagatgaatgacagaagatgaatgtgtttcttgtcccagcaatatttgtattttcattgtagtcgaagaagtgaagatggaatttcaggtgcaactgaccaggtgctgcttcccactctatggtctttatatatccaagctaacctgagatgcaaagctaggaattcacttaaactgtctgccattccatctgtttggacttgtctacaagccaatcaggaagacatatgaaaggtgaacagaggcagcattttagctccttctgcaccctaggattgtacagtgccacagtctccagtagcatgctctgaacatgatcactgtatcactcttccagatggaaggtgatcctgcaatcagtgggctttgcttagcacagtgtaggctacagtcagaaacctgactctgcgagaacattccttaggtgccgggagcaggagagggaggctggacactccatgttgcctgaggccaccaccctttggactaagagacagaaagaaaatcgcgctcacctctggaaagaccaagtcgttgatgtcctgcttcccctcttcagggctgttctacctataaggccatctcctgaagtcaccgtgttttttatataacattttgtccttttagaaattatcctgacgcatgtcaagagctttcacaccgaaaaaatatgtcacattagcttccaagtttctgattgtctaaataacgcagcaactcaacatacagctgtctggcattttgacagtacaataacccataattcttcctgccactcaacacttcaaggttagcattttgtagtttgctctcaaggagtagtcatttaaattttcaagagcaaagaaatgaatgtggctgcttcatacctctcttttgatctttctttatctgggtggtttttccatttatattttccattatatattttggaatgcttatatttgggtgtaaacttttcttggagagttagaatgttgtatcccattctccagatagatgggaataaaaatgagacatatctgctgagcttcagagggcagctgccctgtgagcagttcccaagcatttgcagtggagtaaagcaagaaggaactagtaggcgtatggagtagtttatgactctttcctgcctcctttcagaaggcaggtgaagtacttgcagctgcattctgaggaaggtggagtttccagtttctaccttctcttgagagaaccccacttgcttggtccaacctccatccttgagtctcaaggatgagtcttggaaacccaattaacatctttgacttagctgctggtttctgaattgtcctaactggcttggttgcaactggtcatctttgtaggcacattactacccctaggtgggaaactgggttataaatctggctttcattaattacctctgtaaacttgaccaagtcaacagttttcctctttgaacttctttccttatttctaaaatgaaattactagctcttgccatacctgccactctaggcttatatagctgggataagaagaaacaataaggataaatgtgccttgaattattgagagccatgctatctcaatattagacattattgtgaagtttttctttcaacccactgccagtttttatcccggatctaccttcctgcctgcagtaatttagtggcttattgtgatgtgtgggtcactttctgagacaaagagagtcaatataatgccttctgccatgaacaggctttatttagtggcctttcttggactgtgttcaagagtaaactcttggatcttaggcaccctgaggatatctcagggtttaaaattcctgagataaaataattaagttttagatccataactgactgacagactcaatgaatgtgctttgcctgggaaaagcctaacctctccaaactcaccaacccatgtttaagcccatgaagttaagcacaatttaaaagcctgaatgtgtgtgtaaaaagaatcactgtgtttataggcaatctgtttacactttgaaagccattagagtgatagtgataaaaatttaccagtttgggtcctaaaatctctaaaacataatttgtttgttgaggcctattggaattgatgaagaagagaattaactcttcttcggcatccctgggactcactctgacaagtctgagaggggctggaaattatagaagatttgaatctaggttcatggggagttttgaacgtgtggaatttctttggttcgttgcttttggtgaggaggaatccaggtcaattttcccctatttattaaaggttttatgacccctcttcttcagaattggcaatttcatttgctgtgcatttgctacttctaactggagagtttgaagtctggtgcaatctacttgtataagatgctggagtatcacagtcccatgctacaaatagcctgggctaggaggagaacaacttgatggggtttaccacaaatgtttcgatactagcaataacacagtcacttgaattgcatatcattctatactcttcaaagcatgttgcatctgttaacatagctgatctcagaatagtgccacgaagcaggaaggactatgatttctaaaattacgtgttttttttgtttgtttggtgtttttttttttttttgagacggagtctcggtctgtcgtccaggctggagtgcagtggcgtcatcttggctcactgcaagctccgcctcctgggttcacgccattctcctgcctcagcctcccgagtagctgagactacaggcgcccgccaccatgcccggctaattttttgtacttttagtagagacggggtttcaccgtgttagccaggatggtctcaatctcctgacctcatgatccacccgcctcgccctcccaaagtgctgggattacaggcatgagccaccgtgcctggccaaaattttgtttttaaggattttttcctgactatgaaaataatgcatattcattatagaaattttggaaaatactgagaatcataaagaaggaaattaaggttgcctgtaattccccacttcccagaaataaccacttaaaaccttctggaatatatccccccgacacacatactcctttctgtatgtatttgcacagatacctgtagattagatttttaaatttgagatccttctataaagatactatattgttctaggcctttcacttataaacatttacccatgttataaatagttcttgaaaccccactatttaatagctgaatagttttctgtttgaagagaggattataatattgttgagtaactaggttattttcagttgttccttattctactcggtatcatgaagtatgttccaggacatacatctattttttttttttttcattttaaacacagctctgattatatcctaaagacaaactcttagagatggaatggctaagatgtttctgtctagttttcgaggactattatgtaaagtgatagaaagtcagggattttatccaaatttgatggtgggaaaactgaagatcagagagttacacttacttgcctcagggtgcagagtggagcagccaggtggccccatggaggcactcaccttgctggcactcttaccacctgggaggtgaggacagcaccttggcaaagctaagctaggttacagtgtggccattgtgggctctcttcacagcccctatttgactgtggtttgtgatactgatggagattaacgaaattgtcattctgcttcacgtcactgcttctcagagctttctgggcttttcctctccccctctctccccaactcagtgctctctcagagtggctgcagcccatctgcctggcatgtttgcttgcctttctttttaacctaaaacattttggaggatgcctatcaagttccacaccctgtgttggctgcaaggggtacaaagatgcgttaattcagtcctgaccctcaaatgtcatctaggatgagaatgcgaacaggtaactgtggtgaagtatgaagaagacataatcctggggctgtggaagaatcagaagtgtcccgtttgtaaagcatatcatgctgttcctggtgcatgacaaacctctagtctgctgcctcagtggacccctttgtattcctattctatagtatttgttttgaccagacttatccccaaaagtcttctcacttttgctcctttttgctccttgtctgctttgacttacttcccattgtttttgtacgcagtgggcacctaataagtaatcgatggtgtggcctcatcacctggcctctgggtacctctatcctggccctattcttgctacttgtaagttcccaggaatttgcacctgtccctgagtctcattttccttatttgtaatattaagggaagaaaacccaaataactgctaatgaaaataatagcaagcatgtattgagccttattatgcaccatgtactgttgtaagaactttacacatattagcttattaaagcacacgtcttcgtggggttagggttactgttgtcccatttctcaggtgacgatccagggcccaaggccacatagccgggtggtgggaccatgaggcaggcagacattagagattactctcttgacattgtcctctactttcttaggacccttgccttacattgtacttggaatggcaaaacacttgtggtgtaatttgggagttcaatatggttagtttgggagagcagaagctctcttgagttaataatgtattgcagagcaggcatggggacgtctaggaccttggctgttccctccccaaagctatagaacatcacagaaccagggaactgtggggctgggagagacctctgaggaagagctcctttttcaaccatccattcacttgctcactcaccaacatcttgagcacatgctatttgaaagtcattatactacatgttgctcttgctatggagactaaaaacaggtatgacttctgctctcaggaaactcacaacccagaaagccgggaaatagcatgtcacacagctggtgggactgttgggagagaaagcagtaaggatgaaaatgttttcagttgaaatgcctaattctctctagacttccaggaaggggcctgacaattttggcacaaggactaccttctttccagtgcgtggctcatgtccctgggtctggcaagtccagaattagtagtagagaactcttgtccaaagcactaatttggaggctgagatttattgttgtcacagcacctggcttacaaaaataagctttgtcataatggaggaagaaaagggaggaaaataaagccaggttttagatcagttgcagaatttttttcccctgtctattgaagtttatagtaagtcaaaatgcctggtacccagattgatttgaatgaaaaaaatagatatacatatatatgcatgcttgaacaatgtcaggcttccaatgtgcctctagttcctctgtaagtccccaatctaggagtttcttctgtagcttgattccagcaagaacaggcgctgcttcagtattcatttcagtggcgttgacaatactgacaatataattgacctaaaaagttctggatttcctgttaatgcactttagaaatgtacatcaactaccaaaaaaaattcatttctatctacatttcacttgatttccattttcaagagagaggcttcatcattattattctatttgaatagcactgatatcttgaaggatggaaggagatttctattgtatgcgggagtactttatttcgatattttctttgtctgattatacatgataaacacacattagtgacatttcgtgcatgtttggaagataaatggggatatctctttaaaccattcctgacacttgctaacctgtgagcttaatggcattttctctttgattcaataatttgtctgtcaaaaaaaagctgggctgacattctccttgttgtgggattgaaatggaaagaaatctcttctcttgaagataattttttttttaaattgaggggaacattttaggataaaaatgtttttgaaattatttgggtttttggtgatggaggtggaggacgggggctgggaggatggcgctgatgaatgcgagagccctgacattatatgtgtggcaagtcatcttaaaagggggcccattacctccatctgcaagtcctcttgaaataattagggaacgtgtgaaatcttgcaaatgaagatggctcctactgcggtgtctcctgggagccatcagcctccctcccggtggaggtggtcgggtggggtgtgcatctgtgtgcacaggcatagctctgactccatgcacctgtcttagttcccctggatgatggagaagtcccctgaacaatggtgagagggaaggcagtcccagcctcatgctggagaggctccaaatccagatgcctgttttatctttggagattttggagcagcctcattcaggggctgtggtgaatgtgaatcgagtggtgaacctcgagtttaggaagacatatggtgggctgcaggtgaggcttattgctcatgagggaggcctgtgcatctgtgagaaaggtggcctcacatgttgggaatgagggaccatttcagagctgtatcatgtgaccccaggatgtgttgctagcctgtctcctggggcccctccgtgccctgcatttgagggtttcttggaagtctgattacgtaaagttgatgtgaataggcagggagcagaatggaagaggatgcttggtgttgagagtctgcttccctcccttcccgcttctccaccataaggggtcttcacatgcaccattagaaaacaaggacttattaggccccctcacgttgattcattcaacaccttgtatgtgtgccaggcacagttctaggccccggggaggcaccccaagtcatataacttgcccatagtgaagtcaggaataaaacccaggtttcttgattcctgatctgatgcttttctggcacaccaccctgccttcctggagaccccatctcctgcaggagcctgaaattctttcgcattgtctggttgttcttccttatggcttccggttcccctgtctgagaacgcaggtcagtcatttcatgctgggttaccctagcaaaacacaacaaacacaaacaaataaaaatgaagtcatcaaccatcacatgtgttttcccaggctggatttcccactagcaaatagggcccttcaaaacctttgaacatcctgagcactgttactttagaagccccatcacacagcgtatcaaagatattaaaattaacccccatctcatattaaacatgatttatgaagtttcaatgtgaaattttggggatggattttaaaaatcatttttatagttttgaagtttaagagtaaattcattatggcttaaactttgttatatttaactgtaaagcttgagttgatttgcacttaactgactgatgaatataatgtttctttctgttgaaatttaatgaaatatttatttaatttattattttcatttattatattattatttatttaatgaaacatttattaatcttagttttgcaatttttatttcacattttagagccatttattttcagatatcaaacatttcattggcctttaatgagtttagaggagagcccttgacgctatgcttgtagctcctcatggatgaaaggccctgaaaacagacctctttgcagctacccacccaaaaccaaattgtatactgcaacatttgctgcccttggagaaccccaaatgggcttgttggaaaacctcttctaaaatccctgggactggcctgagtgtcatggaagtgaccctgagggctcaagaagaactgccgtttctacttgccatggtgtcttactcagcttgggctgccataaaaaaatactgcagaccaggtggcttaaacacagacatttgtttctcacagttctggagtctggaagtccaagatcaagagccagctctgtttctggtgaagacttttcccagcttgcagatggctgcttttttgctgggtcctcacaccctcacatggtagagacagcacaccctgttcactcttcttctgagggcaccagtcccatgatgagggtctcacccatgtgacctcatctaaccccaattctctccaaatactgcaacttcaaatactacttatacaaaggttccacttcaaactactgtcacattgagggctagggattcaatatatgaatttgaggaggttgcggggtggggcacaaaccttcactccctaacatacagtgtggtggaaacacccaggcctcagagtctgtggctgtgggtttcacatcccaggcccaccacttttagcagtggttagcctccgaacttcagttcctacatctgtaaaatggggatggtaatcaatctgtagggttgctatttgcattagaagtaatgtttataaagggtccagcacccagtaggtacctcttctcattgtaatttacccagtcatgtgagggcatctttaatgaaatgaaacagcagctgttatgtgtggagttacaacaaagagacacacacacagagcagggagacaggccaggagcatgtctggaggcaagaaaacaggtaaggtccttggcattgaggcaaggaggggctcctacaaaaaaagtttttttcctacatttctgggaagtctcaggctttcagggaactcctcaggttgtgccagactgcaaagagtgggctgagaggcccagccttctgggcctggggatgattcaggaatgaaagatccccaagttgggaagactcagcttgagggtttttcaccagaaaacaatctgcagtttatttatttatttatttttgccatttccagaatggaaaacacaaacggaaatgatgagttttataaatataggagttttgtgcctgggatggaggtggggcgttggtatttatgtgcaaatagccctagattctgcagattaccagtatctggggaaggaacaaatgcccagcatttagaaagccatcagaacagggagcgccacccctggctgcgagaattggtgggcagtgatatggcaaccctctttcctgagtactccaccattagacgggattggtgggtggaaaatcagaggccatgagtagtctcccaaatccttccacttgagtcagcctgcagccaattaaccttcctgaccgactcaaggcaagcctagaccacagtggaaggaacgtcccctggcccaccctctctctctaccatcctctctcccttccttctgccactcaagtgagtgctcagtgtgtatcaggcactatcctaggtgcttgcattaaatccatgggcaaaatggaaaaatttataatagacattaaacaataaatatgtctcataaagacgttacacgttggagggcaaaaaatgctatggaaaaaagaaaaagagagcaggtaataaaattagtagtcccgggtggaagtggcaggacaggttgcagtattgaacagggtggtcaggagaggcagcattaggaaggtgagatgagtaaatggcaggtaagtcagttgagggtgttgaaggacaaaaagattataaaatgaactgtctctgagctcatagtgtctgatagggggaggaagaagccagtcaacattggaatgcctggaatatcatttcttcctaacaaatctgagcaatgtggcttagggagatgaagaatacctgtgcctgccagtccttaatcttatgtggctcatggtaccgctaggcagtgcttggtatcagatggagattgggacctgggtataaagccagagttctctagcccaggtggggtttttgggtttctaatggctcaaaacgtttgttggatgaatgacatgagtggttaaatgaaaaactgagtgaataaattcatcaatgagcaaatgaatgaacaatgaatgaataaagactgattaaaattcttatctgtattaagaatagataatttacaagttcacaccataagttactagttgcacatttagcttcagtagtaatttttaaggtgctttgctatatttaaaatatataggcatttacaccattgagtaaattttcaaatgtagtgaaaaattatccaattttaaatatgtttaggtattatggtatagtccgaacttagattttcacttatagctgtaatcaaagtagaccatattttctgaaccagcagatgactttgcctcctatgtagagtgagagcagactgcttgataagcttgtgaatcacagtttcttgcttatggataattgctgctcttagtcttgagacatgacatagagattgacgcagagtaaactgctggtctgctggttactaaactttgcatattttcagaaagacctggggaaacttacagaaagagcggcagacagtgtcaggcaggccacagactggccacccccaggtctactttatcagaagtttcaggtatggtctccaatgtctgcagtttaaaattgtttctcaggtgattttgttgtcgatagtgtaggggattaaggaaccactgcaccaaagccaactttgagagcaggaggtatgtccttttcttttaatttttttttttttttttttgagacggagtctcactctgtggcccaggctagagtgcagtggcgtgatcttggctcactgcaagctccgcctcccaggttcatgccattctcctgcttcagcctcccgagtagctgggactacaggcgcctgccaccacacctggttaattttttgtatttttagtagaggcagggtttcaccttgttagccaggatggtctcgatctcctgaccttgtgatccacccacctcggcctcccaaagtgctgggattacaggtgtgagccaccatgcctggccttaaaatttttactttattagtgtctatcaataaatggataagtgtaaatcctaattgcaggaagccaaatgagacagatttatccccctccaacaaggtagcatttcagtcttctttctttctctgtctctctttttcttattttgtttatcttctccctaaacataggacttctctgtatgtattactgtactatgtgctttctctttacaattctgatacattatgcatgtctttcaatacatattaaagctacatgatattccagaatgtggaagtgatccatcctttcaacttgttgaaattcattgatttactcaagtgcttccctcatagaaaaatgttgataaacctttgctgactgaataaatgaagagaacatagctatcttgtaccatccaccccacgtcagtttcccataggaagtttggggttaaaatcaagccagtttccttggcacatgtagttccagctacttgtgaggctgagacgggaggagcacttgagcccaggagtttgaggctgcagtgagctatgattgtgccactgcactccagcctgggtaacagagtcctatctctaaaaataaataagtaaatacctaaaaaaaataaataaatgggccaggcgcggtggctcacacctgaaatcccagcactttgggaggccaaggcaggcagattacgaggtcaggagatcgagatcaacttggctaacacagtgaaacccagtctctactaaaaatacaaaaaattagccgagcttggtggcgggcgcctgtagtcccagctacttgggagactgaggcaggagaatggcgtgaacccgggaggcggagcttgcagtgagccgagatggtgccactgcactccagcctgggtgcagtgcgagactccatcttaaataaataaataaataaataaataaataaatgaaccagctgagacttagttcttcttaggaaggttctaggctgtggtgagaacccctctaatgcaggggttcaggcaggcttgaaatggagtcgctgtttcacaaagggaaagagaacagatccgccaatgagaaaagttgatggggcagaggcctcaggcaaggtccagaccctgtcttcagagtctgtgaacatttaaggagctaagactttctttatcttcctggagtgtccacccactaatatagggcaggttatggtgaggactgtgaaagacccaagagccctggagctccctgtgcggcggctgagggtgttcagaggagtgagggtttgaactgagttcagaaggagagtcagcctgagctccgctgagcaaaggctctgggtgactctgccgcttacctggagagaaccgttttgcctctgtccggccatgtgaagaccggctggctagtgtagggggctcttggaaaccaggtgggtaagaaaccaagtaaactaactattctgttgtttctccaagaggagaaacagcagccacaaaaacctcagccctctgcagagcgaagctccaagagcccctttcacagacacataaatatttaataatcatctgtctacaaccaatctaggggaaaaaaatctttaaatagactgctcgaaaggccaaaacctgaattttaattgaggtactttgaattactcccattagtcagtcgctctgactttttcttagtgagggctggattgtttttgaaaggggaatcgaaattattagcagcccttaaaaaaagaaaaaacctgctgatcctactaaataataaactaggcttctttttaaaaagacgtggctttctaggcttcaagcaagaggggaaagtaagatgagccccacattttagagatgcaatttgaaaagcaagcgttaagggcattcagatgcctggctaagcagttcctcggcaaagcacttctgcaatgctccctggtcctgctaaagtttgcaggatggagaaggcgtgtgtgtgtgtgtgtgtgtgtgtgtgtgtgtgtgtgtgtgtgtgtgtgcgcgtgtgtgtttatatatttattttccgtctctctgccccctgggcctgcagtcttctgtagccgatgtaacaatcctcctggatgaacctcttgtatctcatgctagccaatttcgacagtctaaagtgctcaaattgagccattttgttctctgtaaaataaacctcaggccattatgcgtggtttttcattcacccgcctccttgtcacccttcccttggcccctctctgcccaccctcccctccttccccattctctcctcttgctccccctctgacgaatgggagggaagcagacatcctttaggagaccgctgttttcagtccaggcatgtcaacttcactctggcacaatttgctttgagatctgtggcatggagcagggctacagggtcaccccccaaccataattgatcttgcttattcatctgcttcctgcgtattgccctctccccatgctggcctttgtttggataaattgttggaagatttactgtggtgctgaaagccacctgccctggtgtccccaccacctcttccagggtgagacgatagagtggcacttagggaagaaagttctcccttctccccgccatcccaaacctagaggacatctcctggcatcacaattcaggcaatttccagactaatttactatggaatcacttttcacggcccttgtgcaccggtatgagaaatgttaattggtgtgtgagcctgagatgctcttccaaaggatttatcgtcagaatcagaggaggggaaggggagccgaggccgtctttgtgatggcttggaggctgcactcactcgcttcagattatttttaaaaccaatggtcatgatggatctgaatccagtaatttattcgattttgggtcattaacccttgttctgcttatggcagcaaatgacttcatcgtcagagatgatgagtgttccgaactgtggggatacttggctctctcgagctctcatctgaaaatcaattttaagcaagtggcaggcattagaaatcctctctgcttataggtttctgcagcattgcctctaggatttgaagaagcagggagggcgggggccggggagaagcctctggaaaactcccattgccggggtgtttgcgttggggtggctaatgtcctaagaaggctacacaatagactgtcaaaatggttctttcagagtggggcatggatcacagtttagaaatgggggaaaaggaaggaaaggagcaggcctccatggagtgatcctgcctgtagactgaataaaatagcttgaaatcattgttttgattcccattgactgaaggctggaggggctttactggttaagcttttaaagccgcagcagtttaaacacttttttttttgccttttttgcctgctgcaccctttctccagttgactttgaaacacattaactcatctttggaaaaacaaaaaacaaacactgtttgccttcaattccgaggctggcttctctcttgaggtgttatataaataggtggcatcatccagcatcactgtgcagggcacaggggactggcgtggccagtgccaacctgcctcccaccgggtacacactcccatggctgtccacactgcagtcctctgccatgctggacaaactggctggcagtgtttcggatcagagaatttcttccctgcctctgaagatggaagcaatgtttgatgggtgttggagagctctctgagaaagggcccatctttaagcactgcccatgtgagcctgtgttttccttaaacatagtcatgggagatcctttccactgctgactttttaagttgaaatatttagggagaaaatatgagttcttagaaacttttaagtggaagagatttagtaatgatttagccaatccccttatttttttgcagatgaagagcctatggcatagatatatcaagttccttgtccaaaatcacacatactgcagggagcagaagtgatcctgaacccaggtctcctgagcagtggagtacctggggtagggatggcagcaggttgctcaggtgcaggtaataagggactgcactgtctgcagggaatttacaaacaataacaaagcccctcactctgcttttaatgaccaccatgagctgattctcaacaatgtcagagctaaaaacacccctttctgccaaggtaggtgctcccactagccccctccccacctctttgggacccccactgcttctgactcccagttctgtgtttttctcactacactaagatgcatccctcatcaaatagcaaccaaacaaaaaaacaaccttatgttagaagttccctgcttcttttggaattaagtaaggaaaatagccttttgatgagctcacattagccaggaatggtgcagaaaagtgtgatgtcttaaaattcgaagctagggggcccctaaaaaagaagtgttgggatttgttggctctctccttgcctgcatccctctgacatgtgagtgtggattgcgggccaggagctcgcaaccttgctctaggtagattcgacagagccagggactctctgcgttaccttccaaacctaattctctcccatgtatcatcagagcctagggggaacctcccagtggtctgagggcctgaccagcttttatgtgtgtctctttgtggtcatctcggccagactggttgctatccaggtttttcttctcctccgcagccgctccctgaaatgggtgggtaaatatcccagtctgacttcagctgccgagtcatcagtcctgacagacggctgcctctttgccgagcaacccccctcactgcctcctcccccagcccctcatttcatcttccccctgtcagaactcaccctctggcagaaatcttttccgagagctaaatgtgagcctcaaagagatgccgtcaaggtatttttcataattttcaaaggtaatttccttccctctcccccacccgccttctctctgttataattatgtcttagcagctccccaaatcagcatagcagccaagttccctccccctgaaggtggccgccttttctcgcacaacagtcctgggaaaaggccttggagagcaaggctagggagccaaaggcttcctcaccattgcattgagaggcaagctggtggccttactgtcccgggatgaaggaagacttaaaatggctttgtgtcacttttggtctagagagtccactgtaccctgaggtatttccctaagtgccaggtccatgatggtgtttagggtactcttaatctaatttatatccttttttttttttttttgagacagtgtctcactctgtcgcccaggctggagtgcaatggttcaatctcaactcactgcaacctccgcctcccgagttcaagcaattctcctgcctcagcctcctgagtagctgggactacaggcgctcactaccatgcctggctaattttttgtatttttagtagagatggggtttcactgtgttaaccaggatggtctcgatctcctgacctcgtgatctgcccaccttggcctcccaaagtgctgggattacaggcgtgagccactgtgcccaggctatatccatatttttaagagtaggcaacatccattccaggacattctctgcagtttctttaccctcccactccccctctcatgcctccttactctctcaggaaggagccaaggaaagaattcctctttctccctgaatcctgacctctgtcacctctgaatcctgcctgtggctggccctcaacaggtggcctggccacaggaacgggaggaggactggcctgtctcaggccctctgcagagatgcaagcatggccagccctggctgaacggagatcctgagggtaaattatcttccactaggaatcctgagacttgacattcaaaaattctattcattgaaaacagactagccctgaaaacctggtttagtagataaaatctgtaaccacaagaggataaatcgagtttggcttgtttgtactggtctaacttaatatgatctcccttggagtttccagcatctagattttctagatcattaaatccattacttttcagtgttaacttttttttaggaggatggggtagagagtggatatattttttagtggcatcccacactaattgtgggagcgtcatcaaagctcattttgggtgtgaagtgactaatttctaagcccaggggttctgaaggaggattttcatccatttatcacaaaagaccccaacagccagtcaggaaaggggtctgctggctatagccactggtgtagtccacccagaagaatgaggagaggggccacttccaatcccctaaaaatactgaatgccaggatgaggggtgtgggaatgtggccatctcgtctcccgtacctctggatgctctacggggccatggagccattgctgtgagccagtgtgtgaccatgagcgagtgggccaccccctccatcctcagttcctccatgtgactagtggagcagatctcacctgcctctcagggtgagtgggcgaggcagacgagggctgcatgtgaggatcgtgtgcaagtcttaagtgctcatgaaagtagccatcaccatttccttaagattaacgcctccgagcctcagtcttcattgtttaggaaagggattctgtgtgattgagattttaacaccatgtgcccttcccctgtggagtggtggcatcttaaagagtgaatattttgttccagctctatcctccagggattggctttgggcaggtggggcaaaacatggggccaagttctttactctgaggggagatgcataggcacatccctgacttcccatgtctccagattgcatgggatggaaggaggagaccagaggtgagggcaagccatgctggatagtgtccttccctttgctcccttcccaaagtccaggataggaggaggaggagggagtgaggctggccgtagaactccagggcctatgtgagaagactgtcacactctagggttaggggcagggtctgagtgcagttcagggttgccaggttgtcagaatggcttggagaggagcagcagccttgcccaaagctggttcctggagcgcagttaagtaaagtcctgctgtcaacattgggcttctgtttaccggttgttcaagcccttggtctgcactgggttcctctcctcgatggaccactgtcttccaaccagagttttcagccactgcactttgtcatcagacatagctgcaggccacggtgcatctcagaagcccatgtcagggctatacttttgttccaggacagagctcacagcccagatacagcatgagagctttcatgtcccactcctatggtgaagagccaatgggaccctagtgcacttgttcatttcattgtgaatttgaatccatggctgtgtgtgtgtatcgggggttggggggtgctttcctccgagtcttttttaaactttaataagatggttctttaatttttggcattatcctttaaatacatagtccttttggctcttcccccgacccctgtaacccctccaaacaattataaagcataggaacaaagcgggctgggatgtaagttgtgcaactggtcagttcacaacgaggcagtgcgtgcatgcacacatatgcatgtatgtgcgtgtgacagacactgagttaaactcctcatcattaagtggtgtccttccttgggcaccagaagacactacacagtgtcttttcctgcataattggactgtcttttcatacaagctgaggcgcttctttcgggatataagcccatgcagtctcaacaggtcaggagcgatagtaaaaacctgttgtctggctttgtatttggaataatggagtcactaatctacttgatctggccaagtcagataaaggagaaagtgagggatgcctgtgcttcagagatggaatgtatttgtaaaagcgatttctttgcgggagggggagaagggggagacacataggaaaaaaagggagcaaagactgttggaaaccttttaattagtactaattacctcagcagaaaatgttggaagcttaaaggatttgtgtcagcaagtgaaagatcaaagattgctaggctcgcattttaatctgttggctataaaaaggagtgaggggggtggtaatgggacccaggagaatggctgcccaggtggcgctgtccttaatcccttctttactgctgcagccccaggcctagtcccaattacataataagatgatttaatttttttttttttttgctttgactttaactggatgtagaaaagaggaagggtcatttttctccccttcagtgaggatggggtggggcttctgatggtagacttggtagctgcacaatcccttgtttgatttccctaatcagcaaaatgacattttaatttcaaattaaaacaacaaccaccaacccacacacagaagagcgctctttaaggataaaagggtctgtgggtatacaaagaaagtgagggcctttggttggttgagctgtggttgggcatacctggggcaacaggtaaaatgtgttaatagaaagctccacttactgggttcatcaccatgacagttccttacaagtccagtagggcagggacagagggaggtgggggggaaggccgaggaagagtggagttgacaagccacaccacccatcttagaaggcctctgtgtttctctctgtcaccaccctattttctttcctttcagaatggattaggctggggcaagggctgttagcagaccccattggtgctctgcccatattcccttggcaatcaccattcttgtgcattgccaacctgatggcttccaactacagacacctgcaactctattctctggctgcttgaaccttctcagccctcaaccaatgactgatggcaggaggttggttaatatcccagctcccttgtccctaactgagatgtcactgagaagtgatccacattacatcccataccattctagagaagaagttggtggtcaactgctggtcagcccaatatggtctgctgtttctgtttaaaaaaaaaaagtatatatatatatatataattatatatatatatatataattatatatatatataattatatatatatggtaacattgttatgcctattcatttacatattgtctatgactgcttctacatggagctgagtcttaacagagatcatatgacccacaaatcctaatatatttactatctggctatttacataaaaagtttgctgatccctgaccttacggggttaaacccagctgcccttagcagtaacccacctcatactatatcctttattgacatctttccctttttaatctcactttctggtgttttgtgtgatcacttcccaaataaatgacttgctctcacatcctcacttcaagatctgtttctaggaactccagcttaacatcatatgcccatatacacaccaaaaggacagaatccctgcagatagtgctggttcatcccatttcttccagaagccaaggttgacaccatcagaaacataatgaaacaaaatagcagttcagcttggagaactcaaaaatgctttaacatactgcctctctgactgaaggatctgtgctcaagccattgaacctctttgttcaacaacttaggctccttctaaagcttaggctttaggagataggctgcaggaaaaatctagaaggaagcctgtatggtagaatggaggcccactggctctggatcagtgagcgtggctcagccctctggggtgtggcactttgtcttcatgggaggcgtgacctagagtggccaactattagaaggctagcctcctggctgcagcatctaaatatccactccctctaggaaaggctaccagagaaggtttcaggcccagacctcctgacgtttagcttatgtctcttcagaatcatatatgtaaatgtaaagcaactgccattcaaaatctgatgtacagtccctccttgtgtattgtcttcttgtatcttcagttagttaagtttgatacccatttatcatgaggccagagagggacttggttggaagattgaagaaatagatgccccggcactttgccaggtgtattagttatctattgctaagtatcaaattgccccccaatttagcagcatataacaacaaacattatttatcacacagcttctgtgggccaagagtttggatgcagctgaacccaaggtctctcacaagcctgtggttaaggcatggaacagggctgcagtcctgtcaaggcttcccagggaggatccctttccaagctcattcacgtgattgtgggtgggattcggttccacatgaaactaaggcctcactttcttgctggcagttggttggagacctacctcggctccttgccacatggacctctccataggacagctcatgacttggcaatgaacaagggagagagaaggagaggcccagaaagacagaagtcagtgtttttgtaatcttatcttagcagtgatatccatcacgtctgcaggattctgttcattagaagcaagtcgagaggtccagcccacactcaagtggaaggggttacagggctgtgactaccaggagggagggatcactgggagtcatcttagaagatgcctgacacaccatcagctatcaatctgaacatgccactatgctggtatcatttaataatgaggtacccacttagacagatttcattggctatctttaatcattaaatagtattagctactttagaataaaatctttctgaaacttctattaccaactcctctgttttcttaaagaggttacacaaaatgtacttttatgattttcaagtctcatctcagaatctacttctttgaaattgtcattcttggacttctagcctaaagtaatcactccctctgggttcttgtagcacttattttctatattgtttatgtggcatataatcatatattgctttgtgacagttctattgttatcttgagttactccttgaatcttgtattgtttaatttccacacgtcgacatcttgtctctccataagaattataaacaatttaagtgcagcagttgtctaatacttcagataaaagcaactgcaatggaggttttatttaaatatatgttgacttttttcctttgatgatgttgatttctgattcatgatggtgattcttttaaggctactaagaaaatagctttaaaagggtaaaatagtctaaaaaaggtatattactcattgcccttacattgggtggcccaaatactctgattttttttttttttagttttggtttatttattttggtaggtggttttgttttagtttttaatctgttttcctttagtgttaacataataaccattgcttttctcccttttctctattttggccaagaattgggactagattcttgaaatactgctttaaccgagttttctgactaaatgcttatgatcttctgtaacatcctgattttgtgacatcatcattgggactgagaggcagaggaaaaaggaacacacctttattgaacactgactttatgccaggcgttattcacttacctctaggttcatgactgtgtttcagagaatgaagatggattcaagtgtgaacttcagataaatagtgtgctgtacttttatagtctgaatgatggtcatcttacactaggaatcagaggccaggtcttaggaaaagagaataaaaataaatgggtttaaggaggttggatttgaccgccgcatcagtgctcagggtcctcagttcgtaatacctggctcacacagctgcttgggatgttgcctccttgtgaaaccacttccttaggcctggatgagaaccttggcatttcttataagaatagtagtaacttagaagttgtatatgggctgaattgtgatcttcttccaaattcatactttgaaaccctaacccccagtacctcagaaggtgaccttacatggaaataggattgttgtagatatcatcagttaagaagcgctcatactggagcagggtaggcccctatttcaatacgactggtgtccttgtaaaaagaatgccatgtgaagagatgcacacatgtgtggggcggacgccgcatgaaggccggagttaggctggagcagatcccgcgcgaaggccagagttaggctgggccagaagccacacgaaggctggagttaggctggggcagacgccatgtgaaggctggaggtaggctgcatgccaccagaagctaggagagaggtctggaacagaccctcccctagtgccttcagagggagcgtggccctactgataccttgatttcagctttgtccactctaggaatgtgagacaaatttatcttgttttaagccacccagttggtggtactttgcaacaatagcccaaggaaactaatttcacaggagatgtttctggcctggatttgagtctgctacacctcatgttctgtccttggtcctgaatcagtccccttgttttctgtccgaggtctcccattaccttcaggagtctccattctctaaaaggtgtctgtgtgggaaggtatcttcctgtggtagttccagcccagttgctacttcccatggagaaagtagcccatcaacggtgatgaaaatgacttcctacactcaggcagctgtgttggggcagatctgaaatctctgagggacagcccatttggcatggggtattttcctgggctgctgtggcttccagggcagatgtgcaaacacatctgtgaaagttcagggcccctgagagctaatgagagctgaagcttcaacctgcttgatatgtttgctgtcactttcttttctagtgacgttggagaagggaaaagtcatgcagtctgtcaatcttgtcttctcccatgaaattgagaaagttctattactttcctcgtgaagactgacatctgtgccatctcttccaccactgtgggggctccttcctagatcacgatttgggccaataggatttagctgtaacccttggcagctgtggaagacagcttgccagaacagttgtcagaactcaaaggaagcagagcagtttgcccgacaatagacagagcaaaagtcttatcctcgatctaatccagggtttcttaaccttgacaccagtgacactttgggacagataatgtttgtagtcagggcctgtcctgcatattgtatgatgtttatcatcatccctggcctctgttcactaaatgctaacagcaccacccagtcatgacaatcaaaaatgtcttcagatgttgccagaagtcccttggggaacaacatagcccccacttgagaaccactgatctaatcccttcaaatcaccgtagggatctctgggggattttgcagtggtctcgggaaaatgcacagacatgtcgtattaggaaggggtagttttgggtaattgcaaggtagttgaggacatttaagggaattgtacaaggcataaagatgtcaggcttctgaagtttttttttttttttttttgagatggagtctcactctgtcaccaggctggagtgcagtggtttaatcttggctcactgcaacccctgcctcccgggttcaagtgattctcctgcctcagcctcccgagttcctgagactacaggtgtgcgccaccatgtgcagctgatttttgtatttttagtagagacagggtttcgccatgttggccaggatggtcttgatctctttacctcgtgatccacctgtcttggcctcgcaaattgctgggattataggcgtgagtgagccaccgtgcctggccctggagactcttaagacataaagtgaaaagaagcttcaatcaatgcataatcttacagattttaaatgttcagattgttcagctattgtgattatgttaccaaggggttactgtttgctggcaaataggtagggtaactttcatcacagtttgcccaggacagttttagtttacgccattttcctggcataatcagtagtagtgtcccctttattctaggaagtatcccaatttagacagcaaattttatggtcatcttaccctcgggccgggtgcagctcactgtggtgtttgtggacagcacaaatgctaatatggctgtcactcagtagagtgtgtgctctctgattccttcagtcctcgccactccttattgtcatatgtgcatttgttgtattgcagcatttctaagatgtacatttcttttacatgttagcatacctgaatccatctcaaaattgatggattcttgaaattgtcactgaccaggaggcagctgtgatggagttgctgttattagtgcacacttgaattggtcatggtggttcttattatctttgctgcagttgacttatacagatttttggtacttcacatgtcatttatgaactcatcatgatttggcattgaaagacaaaactattgtgttaacaaaaagaacataaacttgacattataaagcaaatctttattattgaaataatgaccttggttcatattttctggcaaagtaacaagcagaatatgaaaaaggaatgttcctgaggcattttaaggtaggaaaaccttgggtcattctttattgacagtgttgttgttttttgttttctagtacataaaataatgttgtgtctataattggtgcagcttggattcattgaaatgcaatgtgtcacctgactggaccctgaagatgtgtttgagttgagggccccagtggttcttttactgcagtagatatagatttgagttggggaattagatcatggatatccacacacaaagagcctgatatctaagtcagggctgggcctgggcttctgaatttttgataagtctcaggagattctggtgcaggtggtccacgagccactcttttacacagtctgatgtggtcactccccttgattccactccagaggaatctgagcccagataagggagggctctgttcatgtagtgagttcagcccactgacccctgagtagtgttttcctggatgctgcatcaaacacaaggtgagctgaggaagggctgcttggcagctttgcctgaggtggggtctgacccagactggaccagatgtgggtcgcctaccctgcttctctcagctgtctgtactataagcgtgtggatacttggtacatggatatgcacatgtggcttttatttggtttccctatgcatgttcaggaaaacatgtcacataaaagcaggtaaaggtattttggaagaaagagagtggggatctatggaaaatgatagggagggaagagcagaaaacaaaaaagaacatttctaagtctggcagaggacgaagacaggcctggaactggaagcacctgcacttacatttcttgagtgctttctggtttgccaagcactttcccaagcttccatttgaacctccagattggaaatggggggctgcctgatgttctttttattccttcaaccccagtgcaggcccctcactctaaggtgaggacatctgggcatccacagccactgactcctgtccaagctgcctgctcagggggccctgggtatggggcctggaaagggcctgtgagaagagtctcctccaggttcccctggcagctcccaatcccctcaccatggcaacctccaagatggtgctgaagaccccagcgagagcccccactgctgttcagaaaacctgaaaagaatagaatatagactatggtggacatttgcactaaatatgcttacttagcaattctgcgcctgaggaatgtcaaccttgtgtttttccatgccttcctatgagtgtctttcacttttcatcactcttccttcaattttccctcagttagtgttctctttagaagtgatgtttttcaagctgccttcagataaatttctggctctcttcttggacttttcttctggaaaggaggcaggattgggatttgggcctgctagtaggatgcaaagagatataacctattgtgcccatggtcacagagcttaattaattgtcaaggagacaagagtaagatacctgggacagttggacaatagaccaaattcatggaccagtggtagagaaagtgttcaaatagaagtcctttgggtattcagtctaggcatggttagctgggtttgggacagacagagaagtctccaaggaaatgggctctaccttgacccgtagttgtgatgcacgtcaatagtgagcaggtgggggcatttcaagtgaagataaaatgaccagacacactactcaatctttctgcagatcttggcagatccttagaaggtgataggaataaaacctagaggtctggcttgaaagcttgggtcaagactgatcaaaaagttagctttgtcaaaagcatcaggctcattcttacctacagacaacccatggtgatcctaagtcattaatccacccagaggcctgtcctaacctgagtttccttgctttgaagtgtgctgtcctctgcaacatgaggaaataatttgctgcctgcttcagtgaaccatcaggagagccagcagacctaatgacatgtgagaatattaacctcctaccatgaagagctgtgaatcttgagcggcagtctataattcaccctggactcttaagccaggcctctccagctttttctctcactcactttctcacttacacccagagagagaaggagagacctgctcataaaactttatattctccaatagtgtgagccttgctgagctgtttagtaatgagtgactttccttttgcagtcatggaaaaatgtatacctacagaggcaggagcagggggaagatattttttcaatgttgcgctttgcatacgctttttcctatgcagaaaggaaaagtgtcctcctgacactggaaaaaatgcatgatattatggaaggtgaccatttcagtgcttgaataaccaaacttctttgtaattctgtactttatgttaaaagtcaaagaaaagtggaggtgaggatactaatcttaagatatttggatattagaagagatcttagagaccttttaaggtcacttggaagcagaagaagcactgaaatctcattaacagtggtcgtctgtttatgcccttgtttcacgagatttggggcttttggaggacaggattgtactcctagtgcctggcagagtgtctaatccataggaggcctcaaattaaagttagtcaaaagatggagccagtcacctgctctaaccccacattttgcatacggaagaaacaaaggtccaccagtgattgactcatgggcacagctagagtttttcttaggcctcaacggcagctcttttcttccatctgcctgtctaattgctgctcttggccttatgatgttttcacaagcaacgtgttattctaatggagactatcttgatcttgtcaattgagtgaaggcaaacacaaatgtagggccaaggcaccatatcagggagtaaatacagaagtgggcaattagcctcagggcccagagtgcaaggatgtgcagatctggctgcctggcagagagcacctagcatggtaggagtccttagaccagaataatcttccttactttgctaggaaagccttccccaccaggcctcactgctccaccagctccatgtgggctgggaggaaacctattttattcatcctaggcctggctaggggatgctcaataaatatttgctgtagggggaataaataaatgaatgaaggatccagtctgtgattgttagggtacctttctattcaaccaggctgtttaatttccgtatctcaagcatctctgtctggacaatggacaatgctgggcacctataaactttttgatgacttatagaggtaataaaatcaaactttcttcttctgcttacttgactagtgcgatgaattaaccaatggttaatgtctactctcggtatatgtaattctcagcctttctgatctcttcaaattactgtcttcttccttctgccatcttctttttttttttttaagaattaattttattaaaaccagtcaaattaaagctgcctctgtccagggcatctcaagatccatccattatggcttcttatcttggcaggcgatcggcttggaaaggcagctcagccattatgcacatacaaagcccatcacttcacaaccaatggtcaattcatcaaacatttatcttttgccctctgagcgtgtgacgctttgcctctcatttcctagtttgggttgctctgaaagatgaagaaaagcaggcgggagttcttttctcccctaactttccccttcccccagatcgtttttattaatcagatttcatacttgaggcttgaaacatgccctgctctctttttttggccatctgagggttagggatagtctgccagtctcatgctgaactttttactgaatggtggaacaattaaggcaatgataaaactttgcgagttttcatcttgcaacccactttggtgcatgggatgtttaaaaatgaagagacctccaaaataatctagcctagccgccttagtttacaaaacagtacagtgaggcccacaggaggcaagggtttgactgaaatactgcagcaaggtgctaaccaaggcaggacctggatcaggttccttggttgttcctaagacagaggctctcccgagctgtcatctccccatgcattcaaatgattctgaaacatatcactatttcttctggaggtttagccactgacctgcttcattttctgaggcaactaatttcttcctttgaaaagaaaatatgcacatttatttttcaaaaacaatctttcagctaaacaacaattggtctaggtttgtcttcatgtactgtatctcagctgatccccattctgatatctgcaaattggacaggtcagggattttctgccaccttgaaagattagaaagctacattttccaagtgttatttttccaaagtcttagctcacaaaaccaggacttgaaaacagagctcatgactcaatggagtggtcttatgctgtgtgtttaccaactagatttgcgtttggcctcattgagttgacaagatattcctcatcagaacaacacattccctatgaaaacaccacactggcttcctgctgccatgagcagcagtcagataaccagagaggcagacacagaggaaatagccttggttcagtgctgggaaaaactctttttctctatgctgcacaactggaaacagttgatctcgtctctgtccctaacattgttaggtgctagtacacagggcccaggacatgccatgagaggatctggaaagcaaagctcaccaaattattctttgagaggttttgtgaaccatagagctagagctattctggaagaaagaaaatggctccggtagcaagccacttttggaggtcaccatatctcctggggccttctttcctgctggagacataaagctatcttgtagtctgggacagaaaacgtgttttcacctttttcagccaattaagacctcacagaatcaacagttggcacgtttttactggctttcctggcctgagtccattccaggggggccctgcccgtggggagctggtctttgggcaagtatttgattaggggcccttggggtccctggggctttgagatccagccgtgtaaatgtctccttttctggttggcttgcaatgagtagacaccatctgttgaattaaaaattccctttatggagggtggtgaaaggcttgtgtagaagagacactgttatctttcaagcaaacagttcatgaggttgaagagcagcgttcttggcccaacatatgtttgcccaatggctgtgggcgcctcccccaccaggctctgcattccgccccatggcgaggtgcacgcataccatggctgcggtacaccgtgtccactctcacatctccctagcaaagaaaacccccatttatagaacccgccaaacaaactcactctttagactcttaaaaacaaacaagatcccgaggccacaggctccatgcgtgcatgtgtggttttgtaaaatctcaagccgtgaatcaaaataatttcagagacatagtcaaagcccaggccaaaccctgtcaccagggtgggaaaaagacaggaaagattcgctttgaggagggaggatagcccagagaaggagaatgatgggagcaaaacatggaggctgtccttcatctagtatgttcctggagagacacctgctccttgtctctgtccttagggacttgctataataccttcaggacaagcataggagggatgggccaaaaacagaaagggcttactacagccctcattgctttcctctcaacttccagagctcatcttatccatgctgcttactgatacgctgtcctgtatggtgtccccttattccaagcccagcgtctctgtctccttcatagatggtaagagcattgagagcagattccatgacttgtgcatcatttgtatccccagatgcatgtgctcactgaattcctgtcatgttggaaatggataccacaccacatgctttttggtagcaaatcagctttctggactgtagcttacttgagtgccaggatcaagttatctcttttccttatgttccctcaccaccaaatgtggaataaggtatcagcagatgctcaaaagattagaattcatttgcattgagacttagctcaagcccatctccttcaccagccccagccccttctcagagtagcactaatcatcccaatctattaccctgcattatctggtaactgcttccctgtctatacctactacttaatagtaggggactattgcacagtcatccttgtagctccagagactagcaaagtactaagcacagagttggcactcaatacatttttataaatgaatgaatgaacaagctatagaggtgtaccccaaggggatcattagcagataaatctcaagccagtcccacctaatgcatacttaacttcaaaggaaaaaaaaaatctaagaactagctctttgggagattcttctaggagcatccatggagtacagagtgaaaggaaaaagaactcgaaaaccatttaggttcatcattatattaataattgaggacgtacaatgaatgggttacaaagctacacacagtgtttggataaaggatgtggcgatggtgaatttccatttctggaccacagctagaaagtatgtagaggtagtttaacatagttggggagcactgcactttatgtacacaggttctaaatgtggcctggtgactcatgtgtgttttcaggtaggccactttacctctctggacattagtcatcttctgtgaagtagggggagagtggaacagcctaaaattcctctaggattcaaagtctatgagtctataagaagactataatagggcatattttacacaaatagagctgtagctctaatatgtagtttactttctataagaggtcagggtgcaaacatgtgcctttttattatgggcacatgttacacccttcccatagttaggaaaatattaaagaagccttgcacagtcccagctagaagaatgaggcatagagtttagtgtgctggaactctgctaccctcttcctaccagactgactcttaagggaccctttggcaaagcagaactgacttaacagcccttataaactatagttataaaggaaggagctccagtcagataaccatagtatctggatagaatattagaagccatcgaatctgatctctatgaagaaattccctctaaacattctccatgattttagcctctgttcaaataagtatagtggctctgagggcagctcatcctttagtgaacagcttctccattttgacaagtttcaaaaaattgattcaagacatttcctcccagcttacataattttctatttgtttttgattctgcattctggaaccctgtaggctgaggactttgaaatgactaagacttctctgctcctggttaagcaactttaggactgtctcaatcactgtttcttacacccttcacctcctggtggttgtccttggatggtgtttctgaatgcaaatccacctttgaatctggcacctggaattcaaacaaagctccaggcacaggcacttaggggccaggagagtagtagagtggattgggatcagatttgcttctgtggtggtcactggcgattcatactaagtcctcttcccagacactgctctttttctaaagcttctacatgttatgtatgtggaattgtcttgttttatttaaaaggaatattaactgtggtttttcctgattataaaatgtatattcatgatagaaaatttagtagctagagaaaactatttgaaaatgactgataaactccttacctgggggttaacggtatgtatctgggagatatagataggtatcacacacatacacacacacacataaatatatacatttaagtgtgtttgtgtatgtgtgtacagaattgttataatgtctctgtgtacaagattgtatattaacagcagtttataaactagaacaactaagaaagatgactttgatgattcttaaccattaacatggaagaaaatgcccagaaaagcttggtgcagattaaaatttgtgtggaaaatggtgaggaccatatggatgacttttaattttcatgcatgagatctttgtgtgtgtactatattacattgtgacttaatttggggtacttaaatgtatagcatgaaaattgtactggctcattagatagctgcctacaatattatttttaattcctgtgtaatattttatgatacagatatattgagctttatttaatcattcttcaatccttgggcatttaggcttgtttgcaatgttattgtaaatgctatagtgaacatacttgtacataaacttatacacatctttgatatttactgaataaattattggaattggaattagtggatgcaaaggtaattatttttaagtcttttaatataaattgccatccagcaatttcactgtctcattagtcttgtgtttgtttgaagtaaaagcttgacaaaactatgttaaaatctaagaaaaggatataaatatttttattagaatattctagattcctaataaagctgaaaatttctcccatatttttattattgacaaatttccttgtgaattttccatccaaggtttttggtcatttttctgttagggcttcaggttttccttaatgatttataaaagctctttccatgttaagggtgttaaatcttagactgttagaagggttgcaaatatattcccaattttcatattccttttaattttttcgagtaaatatttttggatagttgaactttattatttagtttacattagacactgtgaaatttcatcttattgagctgaaaaatggttgattctaacaggatcattttggatcctactgtatctttcttaatatctctttagggtcctgtcccctataaatgtgataaacatctccttaaccaagccactggcaaaaaacaaaaacaacaaaaaacaaaaaaataagatcaaaatccctagaatctacccatagagcaatttgagccattaatcagtattcttcaggtacatttttgaagcagttatgactctacttctacctaagattgtcattttctagcctactttttggcttcctgtcacaaagatattatgagaagcttattcaaagccttttttttttttttttttgagccgagtctcactctgtcgccaggctgaagtacagtggcatgatctcagctcactgcaacctccacctcccaggttcaagcgattctcctgcctcagcctcccgagtagctgggactacaggcacgtgccaccacgcccagctaatttttgtatttttagtagagacgaggtttcaccatgttggccaggatggtcttgatctcttgacctcatgatccaccctccttggcctcccaaagtgctgggattacaggcatgagccatcatgcctggccaaccattttgaactctgaatacaatatatatcttctttattcctacatgagtatctccattaacaactggtctctcaaaacttttccttaatgcacagaatctgcctgtttgagaatctgtattacattttattgatatatatcctacctcattctatgaaaggtttgggctagcttattagaatgaataaaattaaaaagcagtatataaataaatgaaataccaaggctatgaaaaaattataagccttgacaatgaagttagaaagcaggtatggatatcatgaaggattacctttttacaattgggtcacaatttacctctgagcttcctggtagcaaaagtaaaaaagataacatgatcagatacattattcacgttgtcctacagcaagaaaatacaggttcctgagagctatcatctgaccagaatttcatatgggtaattatataacctcatgtatccaaaataggagaatctaccttcttacctcctttttcaagtaacattaactccaagggcttctagctccttattctccattactaattctttaggcatcatatttgaaagttttcttagtattcttagatatggtgcagggggcttcagacctagttaactattaatactttagctttttggctggtcttggattcaggtctctcagatgagtgttgaattttactgtctgcagttcagggattagccatcatgttggggtctcaatagagctttggggttgactttgaccccaaagtcatgtaaccactacttcttttttgttgttattgtttagcaatgaggtctcgctctgttgcccaggctggagtgcagtgacatgactgtagctcactgtagcctggccctcctgggctcaagcgattctcttgcctcagcctcctgaatagctgggactacaggctcacaccatcatgccaggctactttttgtgttttagaaatggcgtcttactatgtcgcccaggctagatgcagttccttgtgatgtcagtgtacactctgtctcacataccctagccagaacctttttcatgttcttctatttcttaaagacatttctattcatcttgatacacttacagtatggattagttgatttatataattatttgtgtgtgtgtgtgtgtatatatatgtatggctatgtgacttgaatggcagaaaaatacacacagccaactctacatactgtatatagtaatatacaacatgtataatatgtatagtaatatataacatgtataatatatgtcgtaatatatagagttacgtatctatgtctgtctttatccatacatttaaggatataaaaaagagttttatggaaaaaagaatatctcttacaggactaggtaaacaaattataaaaatgtataggtataaaaatgtcacccataatcccagcactttgggaggctgaggggggcggattatgaggtcaagagattgagaccatcctggccaacatggtgaaaccctgtctctactaaaaatacaaaaattagctgggcgtggtggcggaagcctgtagtcccagctactcaggaggcggaggcaggagaatcacttgaacctgggaggcggaggttgcagtgagctgcgattgtgccactgcactccagcctgatgacagagtgagactccatcttaaaaaaattaaaaatgactgtgctgccactggaccatttagtgggagatgagtggtcacatcatacctcaccaattctctcttttctcccttcattttccaccaggtggcttttggtcacctgtcctgtccttgtggcttttgccatgcctttgtgggaagttgatatacagacatttcccaaggagctgccgtgtgccaggcactgcagttggagtggtggggggagtataggagaggaacaagttactatttctgctctcaaggtaatgttgaaacaatttaacaactgcactgtccaattagaattgatgctggctggagcagggtctatggtagccctgggctgtagtgggcattggcctcctagtttctggattatgaagaggtctgggggtgccaaggaatggccagggtagcaggaagggcactcagagctgcaattatttacctactgaaggaagtatttaaatattttaataatgagaactggtatacccatgcagacttgctgaatgttactctttcctgatcttagccacatggccccagggaaaccatgaggaggcattctggcctctgaaagaatacgagtctagaggctgccctccttgccactggccagtgtgctggtcctgctgtctgtcccatgcttggatttattggccgtttttttcttagacactcccaggttttggctgaacagtgctcagtggatgaggcagtaccgagccctcactgtacacttaacagctttctaggagtatggaggctgcatggagatcccctcttagaggggcctgggcagacagaaatcatcagagagatccatacagaacaggcagcagccagcccttgcaggtctgggggcctagccagggtagtagacatcagacccaggttaggccctttagaacttccatggccacaccattttctcaattaaaaatatgggcagggatatttagagtcgaggaagtaggtaaagatctttgtggagatcttgctttcttgattggtttgagaacatcccagcctttgctcctggatttggggccaaatatagtcccaaagagacagatgcttttgttttagggtctgtggtcagctattccccatgttcgctgcccatctcatgttggtgcagctctgtcacccctggtataggctggagctgagggaggagagatcgaattcttagcacagcctagatccaaggattgatccaggggttctggaagtatcctctggtggtttttatggtacaatgttctggctggtttttggctgggcaaggggcagggaggaatggctacaaattagaggctcctgcccaaggctgccagccctacctgggcccgggccctggctcttcccctccattctggtgagtggctcatttgcagggaaaggatgaaggtcactgatttgtgcccacccaggagcagaagggactgggcctcaaggggcggcccttctgtggggcccctggccccctacccatggcccccccatgccagccactggcctggcctgggcagggctgcacgcctgttcggcgctgctgttttcataagctaatgagggcagagtgtgagccacaggcgatgatgttgggatattaactctgacaggaagcttgatcataattatcttaacgaggatagggttaattacagtggaaacttaaaagttctctccgtttgaatccactggagcccaatgcgttgtgatgttttgtcattttgatgtgactttggaaaaggcactgggatgctcccagcagccgctgcagctcctgggggagcccaggcagagccctgggaacgagggaaggaggtaagaggatggtacctgtgtgtgagatcctggctgcgttgctgctggtggagggggaggcaggcagcctgcagggagttccaggggtgctgattaggtttccagaacaatccaggcctggatgatctccctccagctggctgtgcctaggtcctgggtgaaccttgctctctcctatcagcccccagcccatacctcagacatcgcactactccaggaagctggtgagtgatgctggactgacagttggcgtctccaccggggatctggttttggggtgcattttgctgtccatacacaaggtgatagcagacaaattgtcattttatttaacagcacatatttgcaggcacctggcatataggggaatgaactcaaagatctacacacatattttttctcctattcctccctagaaaacagcagtaaaaataacagtaaaaaaaaaataaataaagggtaaagccacctcattctaggtgtatgtgtattgtcgtccacgtgtcagctgggacccccaaaacctatcttccccagtactcccatttactatgctctctgccccctgacttctgtgccccagccctcagctctggatctagatgattaaatccccaggagcacaccacactgataacatgaaaacaaggatttattcattagcaatcacccatgtaatatggttctctttttactgagcagctaataacgtcacatagcaaaaagagtctcaaaaccagacaggtgacaggggatttgagactgatcttaccagctcttctgggaagtctcactctggcgtggatttctgccccatagcccaccctgaggggaagaaaggctggctggatggaggtgggcgcttccttggtgctcctgggctctccccatcttcatgctgtgtcgttttgctttatgcctccctggagcactcttggaaaggagctttcttctgcttgccagttgccaaccatttgctgattctcatcagaagaatctaatatttgcataacgtaactcaggaacaatgtgtatttggatgctgcctttgagcggagtccaactgatgtttgtgcacaaaggaattattaaccacccgtaaggctccctaaggggaagtggcctcacctcccctagtggtaaacgggcccagtcctgagaagccttttggcacatcactccctaacccctagtggaggaagggacttcagaagagcccgaaagtcccctgcacaagcctgacttgctgcacgcctcctctgtgggtttgttcatgggcccgtcccctgcattccaaacacacccccagggtcagggcgtctggaaacaaaacagtgaataaaaggaggaaggaaaagaaaaaaaaaacagcgtatgctagtaaccagttagccgtccttcacttattctcgacaagatcctatgagctggaaggaacacagaacaggagagttcagatgggctattgacaggcccaaattcacacaacaggaaatagaggagcggaggcaaagtcccaaaccttcctgcctagatgtgcgtacattgtgggtttttaaattttttttttgtttgtattttttgtgggtacataagaggtgtagatatttatgggtcacatgacatattttgatacaggcaggcaatgtgtaatcatcacatcaggataaatgggatatccagcccttcaagcatttatcctcacaagttgtgttttgcctctcggaaccaagaggaaaaagagaaaggaggaggaaatgaaacacgatgacctctggacccctactccaaaatgtgtcccccctcggtggggctggcagtgttggttggaggagcaggcgtgctctgggagtcgagtcctgagtgggaccaccccgaggtctggcaggaatggaacatgccggcagagctctgggcccagtggtatctacagatttaattacttacaacacatttttatacctcgtaagtattgactccctattttggagtcctcttggcagcgatcccacaagggagctatggatgccttgggaaagatctggtgctgaagttcacactcacagcagatgtgcagacattgcacacgcaagcacacggggctgtaatggaagcactatcagtaaatgaataaatagtgtggacgacatctccctgatttgtcacattttatagaatagcccggcatcccctacgtgtctccctcccgtccacatcgtagctcagctgtcagccggtgcaggctcagcacatctcctgggtctggcaggtgaacgagctgggagtctgtgtctctgtgtaagcccctctgccggccggcttgctttaattaatgtctgtgtgcgcccaggcaagcacttgtgcacaactacctcgtgtcacctccacccccaacactcatgagagcccataaaattaagagttaactttcagcgatgtgtataagcaaggctatttttccctttctgctgtttttttttttttttcctggagccgggtacttaattctttctgttgcctttttatttactgcctcaacatctacagggttgcactctacacttctttcaaaaattaagtgagaaatccactttccataaattaaaacagtaacttcaggccaggagctttgaagcagcaattctcccaacccccgtctccccacccgcagcaaaaacaaataaaaagaaataataaaagaaaaagccctctcagatcggagtgattatgtaattctgcagatgccttgcctttggggcagccactgggacgctgggcagaagcaaattaagtgattagtaaagaaaaaaggcagaggaaaaaaaaaagtcaaaggatgtgaacggagagaaaggaagccttccctgtcgtttcccccgcgactgtacagagaactgctaagaaatgatacttgaagttatatttattattgtaagagggtatgatatttctgggcaggaatgatggatgacaacttgaatttgtgtccagggaatgaaggtgaactgtgacagagttatttatcttgggaatggaggttagggtcagccgaggctgggtgcctgaaggcacaagacattgacaaatttatcctgcaggccgtatctgaagccctttgttttggatcctggctactcactaagtgaccctcatccttcatgttggcaatgcgtgaaggatgcggtgggtgccagcggccccttctcccccgccgcccccgccccgactcctgctactaattcttgtcattcactttgctgacaggcaccaagcccaaactattcccagtcctgaaagggaaggttaaaatatttatttcggctcataatggcctccctgatttagtgcaggatcatttttcctgttgcctttgtcattgcaggtcactggaaggactgagcgcattcaggagcctggaggaactcatcttggacaacaatcagctgggggacgaccttgtgttgccagggttacccagactgcataccttaaccctcaacaagaaccgaatatcctttcctctgcccgctgcccccactccccacccagccccacagtcgtcccccaaccccaccctgcacaaatacctgcaaaatgtcaaatgagttttacgtgtcagctaaattaaagtatgtgaaatacagttcgtgggcagacaaagcattctgtcttctggcactcgggacacttcagagtaatttattataggtcattcataaatgaaacgcaccattatatcttcctgttgctccattttagtgtagagatctaagttatggctgtgaagaaatctttttaatagataaaaatagagaaagaaaataatgtcaccgctgcagaggcagcgaagcccagtctgtttgcttgggcttgtgtgggagggcgacctctggtgggaagtcccgggtaatgccgccaagcaaacttcctctcctgggaggtttctggaaggctctggggcaggcttggggaaccgttttggtgagggaaaggagctaaggtggcagagacatgtgaagcccaggcctggctatgccctcactgggggataccatgctctggtgatgagaggcctaggggacccacgacagtgtatggcctcctctatggaggcaaggacctagtcagcctagggtgagacttacgggcactaactgctctggattctgtagtggggatggaaacagggaacccttgctgcaacctaaggcccgtagctcctgcattgttagtgtagtggattacccggcactagaatgccagctcgatgggacagggagtttccttggttttgttaactcctctgttcttcacactaagaatagtgcctggcaccaagtacaagctcaataaatatttgagggatgaatgcatcattatcattagctattccttattgagcactcctaggaatgaggcatggtgctgggttctttatgtgtgttgttattcatccttaccaagccctgtgagaagggtgtgtcttttccatttacctagacatagaaagaggtgaggtgtaggcacacagccagacactagcaagatgctaggtcctggatgattcagtgtcaactgtgttgtgtccaaagtccaatgtctgcattctactgtgttgcttcagactcagtggtccaatggctttgttttattggatggaacatttgagacctggagtagttaaaccacttgttcacattcatacaataagttagaaatagaaaaggagacaaggcattttcctctagagtataaaataaaatcagatatacatgtaaggcttggcacatatgcatatgccagcatttaagaatgatttgcagaagtatttgttagctactgtttatacttcaagccataagttaatgttttctttattctctcagatattgtctcagtcagctcttgctgctacagcacagtaccgtacatgaggtggcttaaacaacaaacatttatttctcacagtctggaggctggaggtttgagatcaggatgccagcagggttggtttcttggtgaagatactttctcactgtatcatcacatagcagagagagaggaagcaagctttttcaagtctctccttataggggcactgatcccatcagagagatctacccttatgacctaatcacctcccaaaggcctcatctccacataccatcattttggggattagaatttcaacatatgaatttgagggaagaacaaacattcagaccatagtattataaatatgctccttgtggtcattattgtcactttgatagaagtagaaggggagggcctacatgtaaattcacagtctttgtcataatgaaattttggtggaattttcccttcttatgtctgttagtcaaccaagtttcccaatcactctttgaaaaactttgtagtcttatggctttctaggctgtcttagatgatcagttggccaatattctcaaataaatcaaggacagaaggatttttagacatgtcctgtgtcccaggtctccgtagaatattagggtccatggactttggttcatgtctcagcttaatcatatttagcggtgtgaccttggacaagttatcttctgtgagcttctttttctcatttttaaagaaatatgttggactggtcgatggttttattcacagtattgctgtcaccagagataagcaggcctcttggcttcagagtgctgagaggttttctttgtctttggttgagtcctttccctattctgtgcctccacttttccaatctgtagcagtaatgctaagggagtaatggtaatggcctaggagggaccgaagcagaagacactgtgtggctgtaaacctgaccagtgatatcactggtgctgttgtagcacattttcttatcagtgaatattctgaatagacttctttccttttttctcctctgctctactaatgtgattgtgaagatcatcttccccatctacttgactcagaagtcacagagaaaggtaggtaaaatcaggcaataacagcacatgctatcttctcaacccagcacttctgatgccactttttcagctaaatgactctcctacctaactgtgagaatgttgcaggctttccaacaatttctaggttccatattgttattgccaccccatgaaatgctttagatatggcctctatacattagcttttgctgcataataatccaccccaacatttagtggcttaaaacaacaaatatttacaattctatagatcagatgtttggccagggctcagcaggatggttcttctgctagtcttattctgggtcagtcatgcagccacatctacctggaggctcaactggggctggatggtctaagatgacctcactcatatgtctggaggttggtactgggtgttggctaaactacctgtctcttaacaggctagcataagacacttcacatgggaggagtattctaacagcacaagccccatagtacaagtagtcttcaagttcaacttatatcatgtgttaatgtcccatgaccaaagcaagtcacataccaactgtagaacaaatatgggaagggactgcacagggtgtatgtataaagaagcataattcatttctgtaacaatctacccaggagaccttggcattggcatcttgtctccttcagattttactttatatttgtgataaagggagccctagaaacaagtaactattggcctcctaaaaaagtattagctcttttgtgtaaattgaatctttaaacaagttaggaagcttgctgccaaatgaggttttatcttgaatccttttgtgaagttagctttattttaaatttttttggtttgtattttggcatatgtaaaatggttattcaccccacctaccatgtaaaatctagatttttccactttggtttgactcaaagttaaatgtgtctataataatgctgtaggttcctagaccctggacacttgggtcattggcttctttaatcctttagcaagagggattatcacatagtggttaagaacaacaggctctgaaggcagacttcctgagcttctaccctaaacctgccacttttctgcatgaccttgggcaagtgatttaacatctctatgttttggtttcctttgaaaatgcagacaatgctagtacccatcccataggttgttttgaagattattctaagtatctcagacatattagattctagtaacatagtaagtgctatgtaagggttactattattgttgttgttattatcctagagaattgtgtaaactcatctggtttgacttgggccacattgtaaccaaggccagagtacagatatacttctgagtttagaatggttctttgacttgcataatttaatattgccctaatggcattccgtgagttgggtactgttggtgaataattactctcatttttatggaaaaactaggagtggatgagctctctgaagtcacatagattgtcagtagtggggcttagtctagaacccaggtatgctgattcccagctccagactctgaaacccaaaggagcggcaatcattgtacaaggagaggagccaagatacaggaggagtcagcatcctgagcctgcctctgcaaggtcctgctcccagctggggctgctgggagtctgctcttaaaagggattccagagcccagaaccagcatctggaaaatttcttctgtgttcatcagtcaatgcctccctgccatctgcatacctcctgctggacctcccatctttttccaccagccctttttctcattgtgttcagccctcgtgttgatatcctgctctggtatatctgaaagcctggttgtctgagattacctcatctcttggttcgtagggatctcattttctttctttgtttcattgagactggccaggtagtcactggctatggacttgaaccccttccccactgctcacactctttctctctctctctctctcacacccaaccacgagcatgcacacgccatccccaactcttccaccaggaggggtgggatatttggtaatggtctcagccatatcatgtctgaataatcaaccccaagtaaggttgaccacctgaaaattcaggaaagtgtagataacctttgcgcaatcaaatgattctcccccactttccttttggggtgtgtggggggcacataagcagattttatttggaatcacacttcatcttctgtctccctatttgcttcagcacatgtactgaatagccaatgagtttggattatagtgccagcacgaagaaagaatggtgctacatgttacacagctgggctgtggcacggagaccactccagcgagtcagaggtgggactggagttcccatagccatttgctgtgtcatcttaggaacgatttgctgtgtcatcttaggaaagtctctgtaccttgtcaggggcctcagtttctttataaaatggttaacacaaacttcagcatattgttgagaggtttaaatggtataatatgtaggaaatcactttgttaaagactttacaatttcttggcatattttactgttagccaatgcctcgatgcgtcaaaagaagtagcccaaattggaaggaaggatctgaggtacagcacatagcccggtgatggcacctgtgctgtcacacagaaacatgtaagaaccctcatgttccagtgttttaaattttgcttttgtgttaggaaattataagtcactttttcctctagaaatgcagtttctttaagatctgggtttaaatccagactctatcatgtactagctgtgtgaccgttaacccgtttccttaattgttatttcagcatgataaatttctgacatatgtgaataaaaatgaggtatgtcattatgctgtatatttagtattcaaaaacccagtattaggattagctgtggttaaaatcatcccagtggttatggaggttgccctttaacccgcagctgagcccagagggagggatgtgtccattctcacctgggacagctttggacccgcacaactggacacaggctaggaggcttccctcctccctcatgctccaaactttcaaggcaagatgctgctttgatcttgggccctctgcagaaaatctcctttggcaagcctccccatgacagctgggctctgcaatggcaactttctgcagacaacactgaaaaaaaatctcaacgctaagtaccccggagaagacttgataagggaaaccaggtgtgtgccgggaacccagctggagagagttgaaactgtgccaggtagctacacatttttaaaaaaggtacccttaggagaatccctgaaatgatccccactgcagtggtcttgattagccagggacaccaggtttcttccacagattgcctgtggtcaattttctatgcatcttgacaaaaaagaaatgtgagaagttctatgttggatctcaaaaccagccaacataaggctgtgtttgtccttgctgacccaggagacaaagaaaccaattaaaacttctcatgttttatcctctggtggtgctatcagcataaaggcgaaggactggtctagagcatgcatgcagggaggaggtgctagtgcttcctgcctggtgtggatttgggggagaccacctgactcagccaaaagtatcatttatagtaggtagttgaaaggcttaggaagatggagcttctgccatacaaaatacccaaaagcaggcaggctcttagaaatctctttgattcattggcaaaggatggctgaagcttcttggaacctgcagaccccttgcccaggaaagtcccatgatcagagcattcaaatgatccacttctttgtggccagggacagatccaggtttggggagtgtgaaacctctgtaatttgagggagccctcttaaatactatataatcaggaatgcaaaattaggtatgaaatgaatgtttatttggaatagaactgtatcaaaggaaattttaaaattttaagttgataaatttcacaaatgtcaaaatacctagaaaagtatcaatctttattgaagatatgcctctagagaaacttttttcctgcaaatttctcatagtttcattatttggtgaaattttgtaatttttttctagagagaatagataattccctcttttagcatggttgatcgaaaattgattttttaaaatagtttagaaatgtttctttcagtttcaccatttgttattggtagtttcaccactaaattattggtaaaacttttaggattattacattttggagaaactcttacacatttctttcatatatgataggagctgtataagatttcaggacattttggccgggcacagtggctcacacctgtaatcccagaactttgggaggccgaggcaggtggatctcctgagattaggagttcgagacgaacccaggaggcagaggttgcagtgagccgagatcacgccattgcactccagcctgggcgacagagtgagactctgtctcaaaaaaaaagatttcaggacattttaagttgtgtgtgtgttgatgtgtaggcatgtatacatacacttaacaactgaatcttaaatgttctttgaattgatgaatgagtttgttaatcattttgccatcagttttatgttggtccctgcatatttgtgttaatatggtggatagtaagagtattactggaagccattcctactgatactgttggaagaatttaactagacacagaagtgactgcaaattatacaaatattcccccactgaatcataattaaatgttactcctacacaatgtacccttaggtggggattcccatagacattcccattgttactcagctgaagggaaaatgtggtagaagtcctagtggagcgagacagtgatctccacagattatagtgtaaattacctactttttcaaattaaaaaaaaaaaaaatcacatgatcatgtgactctattaccagggtctttcccagggccttggaaggggcctatgcaaacaagaaacccttgacgcatgagctttattagctccatggtagatctacaagtgaaggttcactcaacttaatctaggcctacttccccgaacatggtggccagctaggcttccttcactcgtcattaaatgttgagaaatgactggcatttcaatccaactcagtttcccaatatttcctcaacttaaaagccttgccagtttggggttccattcctgcatatccccaccttcatacagcagacagaaaaaagagccaagctttgaggaatgtttcctaagaggaaagtaggttttggtccgggctttccatctgcagtagagagggcttccctcagtcgtgtagggcccttgtctacgtaaataattagaatcactccaagtcagtatgtcagcaccattctggtagcccactttcttgcagtcccacaaaagaaatactgtgctggccagaagcagtagtcagcttgtctggctgtccttcctggaacaagggcctggccttgaggttttaagacagcctgatccagacatgagttctagtgctccttggagcatctgatgggtcgcatgggtgggctagaaagttggagcaaaccatgaaggggagaaaccaagcctgggactgaggcccgtgcaggtccgggtctaggtccaggcctggggtactctacctgaatgacaccatccagtcctgggtattggaaggggacttaggacattctgaggaaggtacttgaaagcacagggcacctgaggtgtctgtgcccatatctaagggcaatactagcaatgagacttttttctttgtttttttttttttttttcttttgttgttgtagtaatgactgtgaagtatttaaagatagaaactgctagaaaagctgaacttaccctggaattgttcactgtcattttaattggctctatttaaataattttcctgaagagtatgatgattgaactttagtaagtgtattttgtctccagggattttgattcctggccacccacccctctgtactcccaacctcatccccctggtgtgggaccttctctccagtctctatatgaactcccattctcacctcctcattctagtgttcctgtatggccatctctggatgttatttgtgaaagatttgagagattgaaaacaaacttccatgtctatttctctgtctttgtttgggaagcagggaggatgttggtgaattgaagccaacagcaaatgagtgtgctcacaactttcttttgctagtttcccctcttgctagtttccctctcttgctagtttcccctctcttgttagtttccccctcttgcttgtttccccttctcttgctactttcccctcccttgctagtttttcccctctcttgctagtttccccctctcttgctagtttaccttctcttgctagtttttcccctcctttgttagtttccccctctcttgctagtttacctattcttgctagtttttcccctcccttgctagtttccccctctcttgctactttaccctgtcttgctagtttcgccctctggttagtttccctctcttgctagtttcgccctctggttagtttccctctcttgctagtttccccctctggttagtttccctctcttgctagtttccccctctctggttagtttccctctcttgccagtttccccctctcttgctagtttccccctcttgttagtttcctcctcttgctagtttctccctctggttagtttccttctcttgctagtttccccctctcttgttagtttcccctctcttggtagtttccccctctggttagtttcctcctcttgctagtttccccctcttttgctagtttccctctcttgctagtttcacctcttctgcttgtactctgcttctcattgtctctggctgctctcacctagggtatagcatttggccttgcatatgatggtggcagagcatgtgtacaaagaatgcttgaaggaacttagtttggagaataaaagatttaaggaagacatgtgagcttcaaatatctgaagcttcatcatgtggaagagaagaagccttattctttgtgaccccaagcagttaaattgggtcactgagtagaggttagagaaagattcaattccaggggaaaggaaaactgttatggttgtcagaaatggaatgtgctatgtcgtggtgattgcttggcaaatattttagggacccaattccgacattggttggattttgaattcattcttttgtgacaagttgaaatgaagtatgaggaaatctgtgtaacagcccaaggttagataacatcctcacagagcaagaacatcccttttctttgattttaccttctcctaggttcaagtggaccccacttctgggaactgtaatctgagtctttcacgcttgcatatggcatttcttctacccttgtatgttttgttcctgtagctctgctgccattccctggctgggacccccttttatctgccaacttggttaaccctctctcatatgtctctcgaagtcacggcctaaccaggcatgcctatctaaccatcaccttacctaggctcagcttgtctgtatgtggcttaagccaggagttagtatggggactaagttgtcattaaaccctttccagtacctgtgattctgtgaatctatggctcttgctttatttggtttggccatgattggacagtgggtcccactggaagatggctcctggaataatctcccccatcatgcccccctctgacttttctctttcattctctaattccctcactaacagagaaagaatatattttaatgaggccttctgaaataatttctggttttctttttctggtttttttgttttgtttttttcttttgagacagagtctcgctctgtcacctgggggcatgatctctactcactgcaacctccacctcccaggttcaagcgattctcctgcctcagcttcccaagtagctgggattacaggctcctgccatcatgcccagctaatttttgtatttttagtagagacgggtttcaccatgttggccaggctggtctcaaactcctgacctcaaatgatctgcctaccagggcctcccaacgtactggaattacaggtgtgggccaccatgcccagcccttgttttcattactagaaacgaattaagttttatggttttgcatattgtaaaaatattttactctatggaatcttcccttttggtgtgttttagaaacagaactatagaggaaagaaaaatatgatgggacaatcaagtttattcattcttcctcagatgatctggacttagtcttacctgcctagcgaaagttgggctgtgttcccaacagtgggagtgaaaaagtagcaataccgtatacccacagctgaattgatttcagcccccaccctgaggtctcacaggagcagactggactcatcagcgcctgtcagtcatggcctatgctcattgctaagccttttgtcttactggaccaagattcttaacctttgtcacatcactgatttggagaacctgctggatcacttggcagaagtgacaccagctctggagtacctcagtctgctgggcaacgtggcctgtcccaacgagctggtcagcttggaaaaggatgaggaagactacaagagatacaggtgagtgtccaggggttggaccatggtgggaaaagggaaaaagagaaactttaggggatgatattatactctggggtgcatagtagatgtttggtacatatcagtgggtttcccatgacaatgttaaacttttaccttttggtaacctatagccattgtctctcttggttgaggtcacaaaagctaagaaagatgaaaagttattgccttttctactttttttgtgaagtgccagatattaagtattttaggttttccaagttacatggacttgtcacaactactcagccctgctttcataatgcagaagtagtcatacataatttgtgaacaaatgggcatggctttgttccagtaaagctttatttacaaaacagatggcaggccagatttcacccatgggctgtaacttgctgacccctgctctgtgttgtaagatctttctgtggtctgtctcagagtcatcttgaagagagagatgacttcccaccaaaatttagggagctcatagacaatctcaagaggaagtcccacaggcccatacctctccaccatagagctatgccgtggcgcccaccagccatgcgctttgatgggctccaagtagaaatgcttttcgttcttctctctacttctcaaccatgtgctttaaaagccctgatccaaagtcatttagagagtctttttggtcttacccattttaccaaagtcacctaattttccttcttcatttaaaattgtctgtgttctcattgttgattgttgttttgtaaatgctttaatgaccttttcatggacctctctctccattatgacataagctctcattaaacaccccacctgaatcactcttaaaaataacttaataaattttgtatatgtatatatgcatatatacatatatgtctgtgtctatatgtatatgtatgtgtacacacacattcatgcacttgttcatttattcattcattcatggggccaagaagctatgtgtgaagccaaccatgtaggcaagtttttgtaatttttttctagaatgagagaggtagggagggattggtctcaagtacagggcttatgaggttgcaaaaggaaaagaagagctaagaaaaatttttttctattctttttttggtgtatcatcagctctcaaataattactatttgttttttctattgtaactggtcgcattagcaaaagtactaagaccaaggtatgtggggtcagatcagaagatctgatgtggagtccggctttcccagtggggcttttaaaataggaggacagtctatatcagtattccataatcaaggatctacctctgagtcatccaaggtattctgatgcagttggtggcaattacaacacaacagtccataggtgtttctgatgtccagttggctttagaattcggagacactcagctcccaacaagttcaatttcttcctttactgtctcacaccattttatagatcctatcttgtgtattttttctcacttcttcatgtatttccacatctagagaatggcttccagtgggtaggagctgagttgtcttgactcttgaagcctcatcaatgcctaaagtagtgctggatatgaaaaaagggcttggcacctttttttttctggaggtggcttgaaaccacctttccttctcaggaactaggaacttatagggagatgcagggatctttggccatctcagatgcccactgcccatttggaatcagatccatttggatgtcaacaaatgcagctaataagcaaaggactatgattcagactcaatccaagtgctggttgtgggtcatgaatctttagggagggctggattctacaagtgtggtctatctcatgggctagcctgggcaccctccaagcccatcctccccactccagttctgttcccttggaaggagttgaggggtggggctagggaggtggtttgtgagtacacatatgacaaagttgccatgagaggctagattctagaggtcatacaaaaccaaaatcataactagtcaaaattaacttagaaaatttacatcatccacaatgatggcaagatgcttgcactctgagagaatcagggactaggaacagcacaaggaacagtaaatatgttcccatgtagttacacattcactgcacagcaactggttgaagagtggaatggtaggctgattctctagcacatttaaattttttattcatttaatctctttattttttactgttggtttgatgagtgctcacacttgtatatggaaaagatagatatgtgcttgatatagttccattctatggtctgtaagcagatccgctttgtccttcctcgagtttgtgctccatttgccactgagaaattttagggttttgcaatatgacttttgattctggagttcctgtggcatttgtgtttatacaaaacaatgcagctgccttttttttcttttggtaaaacattttcctggcccttcatccacaaaacacgaggtttgccttccttctagctgtttcccagagcctaatagtagagcctctatgtaaatttatgtgacgttttcactagaaaattgcttaaaaatgaatgctatttctagagtttactgtttttcactttaagtacattttctgacaatatgtcttctattaatcatttaagcaatactaggagccttaaaggagtgtattcagaagcaagaacccatggttcatttagtgctgtctgaaaaaaattcttattgattggcatcctctgtggttatgtgatgtaatatttataatatgtcacccaggcatacatcaaaacaagtgtgtctgttgtttcatttccatgggagatgttgatttcaaagaggtcagcccagtttttaggtcacattgtggccaaccactggaccagaaatgggaagtgactcgatttatgtagttattggaaatggcatcacagagcttgagtttctgtggagtctttcctcccctcctcccaaattcacccttttcacttcctcacttaccccctgtgcacccagttggattttcttggcacacatccccaccataaaacaggctcattaaatttatatgtgagcatgaacatacaaccaagttgttgagtagcaccctggccccactggggcaggagcagaactgtgcctggggtttctctttgccattcatcatagttcatggctgagaaatgtccatggccctgttattataggagcttaaacctgtctgtgattttcagtgtgtacacaccatgctgctattttgggatgaatgtggaatggaggtgaatgtgataatcagcagcctccaggatttgggcaggaagagaacagcagtgcaagacttggccggagagaccaccatgctactgagaaaccactttagtgccccttgtggatttcaacgctagccaaaataacaaatcaatatgggaaagttgggtgcccagaatggtctatttcttgtcttcccttgccattgctttttttgtttttgctacagaaagaacaatggacttgaaggttaacagtagacaagtctggacttcacctttcaaataagggagttggtctcatggtcttttagctcttcctctgtcactgaaccctctgtcgttcatcccctcctgccactccagtctctggttggccttgctttactccctcctccctgtagggccttctgtattccttacaactttcaattatttaaaacgtgacaccctttctttgttcccctgcatggagcagccctggggcctgcccagtgtctgcagcactcagccaaagggaaggagggagggaccctccgccgtctggtcgctctgggctgccaccatttcccagacgaataggagctgtaaaacttgtggcttacataacccagtgagcattctccagctaatctacaatctgggctttgaagatcacaagaaagcaaaggtcacgacccagagatcaaagtgacagaagcccacagagtaattgccggttactctctgtagagggccttggtctgtcctgtgggtgtattgtttgcacagagacttcaaacatgctgccggtgaactgtgaggaaaatcagctggcctctgccagttgtcaggcattcatgaatgctgtaggtgagctcacctcggctcattagagtgagattgttgtcatctctctgagcatctgcagttattccactcacactgtttgttcattactctgtggtctttattgactttctcacagtcgtcatttacttggaggtgttgggggtggttatataaggaaattggaataacaagaaaggacgacatggacatttttattgtaagtcaactttgagccacgtagagttcaagcaaggtaacatttgaaagaggcttagacatcatttggcccatccccttcacagcatagatagaaaaactgaggctcagaaaggcagcagagactgaaccaagatcacagggcaagatacactcaagagtctggcctctttcactatgctattagtccccaagctttttgttacaaaaacttgccctccttttatttttctccccaacactttaaaaactttgatctctcaaataggctgcactgaagccattgctaagtttattattattatgaaacatatacgttcagcagttgatcacggcttctgttcagcatgaggtaaccagtgctattaaatggagttaatgtaatctagtcaacagtgaggaagcatgatgttttgttgacggactcatctatcccatcaagctttgtgaaagattgagaatggctcacagatcacccactgctgccttcaggggtctcaggtagcgcatcagtagcttgtaccatgtctcactgcctccaaagaatagaagcaagaaggcagcaagaaataatgcaaagaagcatagactgccgtaaacggaagaaaattttaaaaacgaaacaaaactctaatgaccccatgcccagttccctcaagaattggaaacttggtacttcttgaatagagtgtcagagaaaaaaacatgtcagccaaccccattcgcagaccgtggaggcccatctgagcttttctgtggttgtaaggtgttcctggggagcagccattgccctggggggagcagccattgccctggggataacagttacaggcagggggaaagaacatcctcctctctctctcaggtctggatgaaaaatgcctgagtgttgggactagagcagagaaaattgattttggaaagaaagaaaaaaaaggtatttctcctgttccttttctcctcctagcggttttagctctctccttagaggagtcctttaagcaaatggaacattctatgtgagaagaaagaggacctgaaaagctcaatgtgctggtctctcagatttaggaaatctgtttccagacagagacaaatgggtctttaagcaccttcccaggatccctgctctcctcttgataaccccaccttctgtatctcagccaagagcacctctgactctcacccccacccctcaccacccccagccttgggggctttcccctagccaccttgagaaggtcaggaaaattggagttgccctctggagctagggacgtgagacttagaacttagaccgatctcttttcattaagcagtgccctggcttaacaagcagttttataaatctgaagctgtctccgggtgtcgcaggatttatagacgggggtttctgccataaagtggtttatgatggctgccttctgtgttattagtagctgtctcttccttcaaccattgctgtttgataatagccttaaaacacccagaattacttacctgcaaaccctattcccgatagcccctgttgacagtctgaataagtttagtgcccttttgttgtactttaccttcaaaacaaactgattgaaccatcaatagctcgtggaagctgacagagggatgtcatctggactagcccttgtgattgcaggttatctgggggagttaaccttcccgcattgttaactgaaatgttttatgtactatgcaactttaggatacggctgtgataaccccagtaactaagtaatacatcacagtaaagagattttggtgcaacaaataacccaggattaaatttacaagggttgaattgatattgtaaaagccttcattctgtggctttgggaatcctctcttgtatttttatggcaaacttgtattacactcaggattgaagctgtgccttttgacaccctgacatgacctagaacaaagggaaatagatctcccaggaccatgaaaggacaggcaagcaggaagcccactgacttatcacttggcaataatgtttggagcgagttccaagccaccaaggggcaagaagatctggcagacatggccactggctgggttctgtgcactgcaggcattggggcagggcagcccttagcagaactggaaggagaccctttgctgcctcaccaccctcctaatttcaaagctattattcctcatggtgttattttcacgaggacattggttctcagcaggactagcagcatcagcatcacctggggacatattagaaatgtaaatttcaggcccagttccagaaatactgaatcagaaactctggggatggggccctgccatctgtgtgttgggaagtctccaggaaatactgatgcccactgaagtttgagaaccactgtgcaagaatagaagctcactgaaagagcacagatcttctgcattgcttttatctcctcatgttggtacttgactcaggtcctgacacacagtagctgttccataattattgttgaacgagtgaatgtatgagtaagtaaatgaaagaagacatctctatggaggaactttggaccctgggctgaatctcagatggaactatttggggcaagtcctcctagtgtccctcacacctctccaagcagcaaccacttggaaacccaggctggcccacgggatgggtgaaaatcatccctcatttcagggggtgactggcagcctgtgtcatgggctgtctcttcgattgtataagaagagtgatctgaaaacagcagctctttgtcatctaaaatttttaactagcttaaaagccagcacctctgtctctctctttctcctttgatttcagggctgtgatccaaagtgaggcaaaatgacaatgtgcggtctgttgtcatcatggttcctgccagccccgtgaaggcatccttcactccatcgttaaacattggctgattttctaatactgatgttttcttcacctgaatattcatcttttcccaccctacacttagtgggtgtctttactccctgcacgtcactcctgacatattgtttctgtctgtacatgtctttatttgaaagagtctgttgtcataaagacttttctgctacaagcagaagacggaagttttctctgacattgactgaggccggtgggagctctactggaggatagaaaagatatttggtggtggttcatgcctgtaattccagcagatggatcacttgaggtcaggagtttgagtccagcctggccaacatggtgaaacgctgtctctactaaaaatacaaaaataagccaggagtagtggcacacacatgtagtcccagctacttgggaggctgagacaggggaattgcttgaacctgggaggcagaggttgcagtgagcagagatcatgccactgctctccaacctgggcaacagagcaagactccatctcaaaaaaaaaaaaaaaaaaaaaaaaaaaaaaagaaaaagaaaagaaagaaacaaagaaaggaaagatatttgggtgttttgtggcactttcttgattttgggtgaggttagcaggtatttggagggaaggcagaacccagggtaggaaaaggacaatagactgaggccagggaggaaacaggaagtagccagagtcaaatttccaggacaccaggcatggggtggacatttctgaaggaagaaaagaatttcataatattttgactttaacaatgagtcctgtgaaggttattcctgcagacctctaaactattctctctggctttgggatggtcagccaagccttttacctggataagcatatgcaggccacttggtgataatgtcaccgaatccttgggttgttacttcctcagttgggaacctctgtgactggtggttcctttgcctgagttttgcttgggcctgctgagcttgttccacctactcggcctggtgggctgcacttggctcgtgctgccagttcagatcccatgcctgccaagggtgagccaggtgtggagtggtaaggggtacatgagcaagcaagcacagggtctggccactgcatacagccaggcatgctggaagcagcaggctgggcagctctagacactggcatgggcactagctccctgtgaggctgcatctggaccaggcataccacaaccagcttccactgcaggcactggggaacgtggtggcacctggaagcttgaagatgccaggaaccacagagccccaaagagggtgtcacagcctttgcttggggagctgttaggtctgggctccccaaagggccacagctcttctctctgtctcatcacccaccatgtggcgagtggggggacatgtttcagccctgtttgtgttacagctctttcagtcctgccatttggtgggtcccaagttgttgtcccagatccaggaagaatgaagcatgcacacaattggagggtgagcaaggcaaagaggtgctttattaagcaacagtacagctctcaggacaactaaagtgggtagctcctttctgcaggcaggtcatctcagtttctgtgcagccctcagcagagaggagacccagagtgggtagctcctctccacaggcaggttgttccatcaactgcccaagtctggctgagtctggggcttttatgggcatcagaggaaaggaagtgcatgctgattggtccatgggtggccacagcagggtccagaaaaagtaccatatgttctcactctgatttacgaaactggtagcccagcccctatgctttaggccacctctggcctgatggtggggtttcaccggggacacacccctttccacctaggagcctgtctgcctcctgctgccagccatcaacctgctgtctatagtgcccatggtgcccaggctgtttgtgccaagggatgcctgcaggcccatgctgagctgtcctctgctgtcccttggcctccctgctgtgctcatcagcacccaaagtccagaaggggctgaggtggcagggggctggtgtttcagtactgctccgagcatgtacacactcagccagattgtgacagtgcctgggcttggccgccactttgctccaaaattggagtgggcattgggagtcgggagaggccaggcagtgggagcaggcactcccaagccttccagtggaggggggcttcccaagcccccaagagcacagggatgcctgggtctgcagctgcagctgggcagctgcagttgcacctgggagcaggggctcctgccccaccaactcaggagggcatggggctcccacctgttcctggctcctgccagctccatagagcaagcagcccctactgcagctggtgtatttgcagcaattgctccagatgggctgctactgccaccaataatgagaccaccttacgaatgtggaaggtggccttgggaacccaaggctccagtgaaggcaagccacactgttccaagtaacatcctcactgaggaatagctaggttcttggggttgccttaaggtgtggttccttgatgcccatttgagatttcctgtttctccttttccattgagttttcagtcagtagacctcttgctctgtgctcccataaccactctatgcataacctcgattttggcacttagctatgcttattcctaatttctccatgtgagtgtataatttctgttacactgagaacacctttgagagcaggaagcatgttgtaatcacatctgtatccctaaggcctggcacatagtaggtgatcaagaaatatctgtgcaactgaaatcaactggtatgttattgactccattctaatgccagttttcaagatgtggtgagagtgagcaaataaatttgtccctgccttcaagaagcttacagtttgggtaaggacattaatgaacaccaagaaaataattagaaaacaacaaaatgttagactgtaaggtgctgatggcatattctaggagtcctgggaagggagaaagcaatgaagggtggaggtgtacaaaaaaaccttcacaggagatgaggcttgaaagatgagtatatgctgaggaggctgggtataggaaggaaatgacagattcccttggagataatccattgctcttgacactgtgtacttacctcttgataagcagaatagggtggaaacaactcgcttgtttgattgttggactatggaacttgatggaaagcatcttggttagtgattgtccctgacgagggagaagtatagacacatgtccatacctgttatacatttatttatgcatttatataactataccctggccaagtggttattcttgtcaactccatatatacctatttgaggacagttaattacactagcagccattggcttatttctggagtccatctgccaaggaattcttccagggaaatggagagcacctagcatttgttgggccattaatatctcctagaaattaactcccccttttctccttgataatcttcataggttagcaagtgtggaaataaccacatgtattatcgagggatgatgcgaacaaagttcttaagacccctgcctgattcctcaaggaagcatttctcagctacatgtgttcctcacttgtaacccacagtcatccaggtcattatagtctatgatacagatgacccataggaatggcagtgacgtaaagggtacaatcaatttataggtttattttactgagaatttctgtgtagcaaagaagctgagcctgttttctagactggaaggaagggcatgcgttgatagggtgccactggctaacccacgtgtgtgtgtgtgtgtttacctttgagccaagtgtaccattagtgtgtgcttctaatgtttagttgtgcatgtgtgtaagatagaatcattctgacttctccaaggaacagttgtttattctttgtgaaagaagagaggaggcgcagccaaggtctaagttccagaagaccggatggtgtggattcttgaagatcagacaagctgtcgggatctctgaggctgccactcaaacttcctgagttgtctctgactcttatcttccagatgctttgttctgtacaagctgcccaacttgaaatttctggatgcccagaaagtaaccagacaagaacgagaggaggcgttggtcagaggagtcttcatgaaggtggtgaagcccaaggtgagctgcctacttgctgttcttcacaagggatttacatctcatggcagtgcttacaccccagggcatgcagaatgtcctctgagtgtttagaatgcagttggaatctcacatgaagggtccttccatggatacattgttggccaaacatgaaatagggttaggtgtaaattggatcttcctgttttaccaataaagcagcactatgcatagcccaatggtgaagttctgtgggggactgcaggtctccttcttggaaatattcactaagtggggcctctgcaggtttgcagctgagaaaggagaaagaggaaagcattgggcatgggtgggctttggggtaggggggattcttctagtacttcagagggggactttcttgtttgccaccaaagggaagctagggaagagtgattttcttccatcacaggcaagggctccacggccctctgagatatcgttagtgtggaaggtgatgttttctgacagtgtgtccctaggctggcatgtgccccccacatgtatctctccagagctgattagagtggtgtttactgacctttcctttaccagctgagtctgtaagtgaatttggtgtcatgctaatggcagctctgatgaggcagtggagaattggcttggggtcttggattcagacacaaggagattttttaaggacatggatgactatctctttgggaggagttgggagtccttcagtgaagccagaggctggggaatggactcggtgacccctgatgatctccttggagaaccatcattgccttgaggctctgtggagctgtgtggtcacctcccatgagattgcaacttgtgtgttgaaaatgctggcactgatatcctagaagtctagtttatcctcagctattgacttatagcactctgcatgtgcattggaaatgattaaaggggggaaagaaaaaacaaaaacaaaacagaacaatgaaacatcttccatcaagttgctctgctggcagcagacctcaggccactttctttccctgaatccatgaggtgcaacttattttccattatgctgaataaaattgctagcagttgtggaaatatgtgatatggagggtatattactggcagataaatgtattgttacctctttcagcatgtgggaaattaattgagtgattcatttcatagctattaaagtgttaacagtgctccctatcgaggcacaggtttgatgtattgcacacaactgcctttagttattctagcttttgtaatttttccaaatgaaataatttatttcttggccttctttttatttgtttttggtgaaaacagtccagagatagccagcatgaccaaacccagcaaaagtacaacaaatgcactctataatatcctgggttattataaataacctgcccaccctacatatctcaccttcttgtatacatctgtattcacgtgtatacctgtgtgcagagtggatcagtatttctcctgcgctcattgactttgatgtgggcagctctacattgtcacacaaaatctgaaggggtaataaatgtagtacccaccatatctggatggggcactcagtgcatgcccaccccccattcttctaaggttcttggtgcacagatctacaagtgttcacatcatcctctaaagtagaaggaaggggtcactggctcgctttatgggtgagggaactgagggctggagaagttaactgggctgccccaggtcacctggctagtaattgtggagctggaggtttaccttgtgtctgaccactgggcccacactcttctctctctgctttctcacccctggagcagtgagctacatatttaccctgtggatctctttgttcaaacaaaacctcctaaggtctaaatgaggaaaacaggtaagagcaggactgttctgttgagtagaggtgggaggaatcgaaatccttccttgcttttgaaagtatctgagactggctccttaaaatccagcattagttgtttctgagtcattagcaacatcagcagaaatgccctttagggttcccaattagtttctaatcaattctagaattagttcatgtttgtatgattgactccaatatccttactaactgtattaagctttaaaaagcctgttaaggtgtaaattagttcaaccattgtggaaagcagtatggcaattcctcagagagctaaaaacagaactaccatttgacctagcaatcctattactgggtatatactgaaaggaatataaatcattctatcataaagacacatacatgtggatattcccagcaacactattcacaatagcaaagacatggaatcagcctaaatgcccatcagtgacagatcagataaagaaaatgtgatacgtatacactatggaatactatgcagccatacaaaagaacgagatcatatcttttgtgggaacatggatggagctggaggccattattcttagcaaactaatgcaggaacagaaaaacaaatacatattcttacttacaggtagaagctaaatgatgagaactcatgaacacaaagaagggaacaacagacataggggcctacttgaggctgaagattgggaggagagagaggagcagaaaaaataactattaggtactaggcttggtacctgggtatgaaataatctctacaacaaacccccgtgacacaagtttacctatgtaaccaacctgcatatttacccccaaacctaaaacaaaagtttaaaaaaatacctgttaattatttgaggagagagactaaagtactcttacaaagtatggtgatcttggttctctttctgtagtcacatgatttccagaccaaagaggacttagaaatcacctagtctgtgctcccgtttcatggatgagggagctgggagagggtgtagtttcctgaggctccatggaattgggaccagaacccctgggggtctgggcttccagttaagtgttcaatttatgccatgattcttcaagtgcccaggacgattcttctgtgttcttggtttcatatcgaactggatgcctacattgaatggcaggcagttcccttttgtctgttattttcagagataggcagtggtacttttcttgtagaaagaaagacgccaaatgagctccttgctgaattaataaattggcattaaaaaggctggttctcacctgttcacggtgtgtacagacatatgtttgttcccatgcaggtgtgtatacccgcttccgtctctgtgtatatatacatatgcatgttctgggaggtatgtgtacaccagagtcagcttctaagtggcaagcaatttcctttccatgtgttgctgctgctgtgctgagcacactcagggaagacctatttttcacgatggaatcggaatctcaagctggctcctgtcctttccagggcagccaaggcctgttgtgcttattcagcagaatgctctgatggatgattaaggtggccgtgatttggggagctattttcattttattcctgacataaagaatttgggagaatggaaaatgtccctccaatcacagctcttgccttggaggtagggaaacgggcagtctgggtgttctcggctgacacaaatgcagaaccatccaggaggtaataaaggcccgatgtcgcagaggtctgattgggtacctggcaggcgctggcgcttgagtgcaagtcctcactccctttctcccatgatgacacatttctcctccgtggctgccttttagcttttgttgtttcaaagctggcttctgtctgagctctgattgttgtagagaaagatgctgtcattcattaggaagtgatagctgaatgctacaatggatgcttccagactttatctctctgtgtgtgtgtgtgtgtgtgtgtgtgtgtgtgtgtgtgtgttattagttgatggacctgcaacagctaggctttgtcatttccaaaattcaaatatataaaatatatataactttatcaaatattggccattgaatcatgccattgttaatacagagaacaccacactggatacagagaaggttcaagcccccaaagaaagagcccgctagtaaccaaactgtgaagcccctcactgcactgggaaacatagatcaaaggggtgcagaggcctgtccaggatgacgtgtgtggtcggcatgtcagccctgcacagcagagagacagctcaaaaatccgacagtcagaattgtttaattatgtcctgactttgtaattattcatccctgttctggcaaagagcacagttgtcatttctttgacataattatttaaagctgagccctcttgtttacaggcatgtatacaaagttggctaccaactgtttaatcttcagaatcttaaaggagcctaaggagggcaactctagaaagtgttttgacgcttatgttttgcttgcattaatatccatcctcatagggaagatgtggtaataaatatgtctgtgagtagtgaggtgtctttgaagacatgtcacttgtttgtttatgtgggcacagtgtgttcaaacgtatgttttttcccatgcaggtgtgtataccagcttcaatctctctgtgtgtatacatatgcatgttctgggaggtatgtgtacaccagagtcagcttctaagtggcgagcgatttcctttcctgatttttccacctgattttcccatcgtgtagtttgtgtatttgtgtagtttgttgtagcttgtatatttgtgtgtgtgcctacgttttgatacttgggagggtgggctattgtgtatgtgtgtgtgtgcatgtgtgtttgtgtgtgatagaaagaaggaaggagagggagggagatgccctgtgttgaagaaataaactttggagtacatgcatttccaaaagtctctcttattcttttcccctaaactgaaaattggaaactatttgggcctgagaatcacctgctcccacaaataccctacatagtcctgccattgactcttggagttaggtcctcactcccctgggtacctttagtttcttccatctgtgtctgtgtttttaggtttccatgcaaaaggccatctaggatgaagacggaatgattcataaggaagctggcttctcattgggatgaggaagctgctcgcccctggggtgccagctccatgagggcaggaaccttgtgttttgttcgtttctgtatctctagtacctagtctatagcagaggctcagtcaatactcatcaaaggaatgaaccatgaacagcagagcatattggaagatccatcatgaaaaggttgttgtatgtgttctaattacttcagtcaacatggttacattaaaaggcaggaaagaaaccattgcctttagactgtgtgttaattgccacctgtacactggcagaaaagacagattctgggcatcgtatttgtttttccaaaggattttcctgggattatttatgatgggaaaacctactactaccacaatccccatgacttggcttttccactgggtagcatttcacggggaggcaagggtgtgatctgaagctgcgttctcctcgtcactcggggtggtactggagtcctccttctttctcaacccacctgctcatattagggcttttaggaagtaagtagctcttctcatgaaacatgttagggtacccacaagtctgtgtgtagttacaatgaaattttccgtcttcgccgctattgtattttttgtctatacctaaaggagcactacctagttgcttctttgctacacttaattgttttttatgcctagtgtagcactttactaagtgctatcttattctaaactacactgcgtatgtctttgatatcttctgttactcctatgtagcccaattgcaaatgcataaaagggtatcagaaactacttctaggtttattacaattactgtcctttatactcaatattttcaagaatatatattttatataaagccaggacatgcctataaataaacattataaatcacaagtacattcagttcaacagaccatcagccaatatattttgaaagttctccacagtgccaaacattcaaaaaataatttaaaatattggttgtttttctggatgtttccaactacctgaatgtgctcatgtttttatgatttttttttctgttttcatgcagatgtttcttgtctagagacatattcagattctattttcagtttctttctagtaaattttggagagaggaaaattttttaattaactgttttttttaagaaaatgcttagatggtgtgttcaaaaacaactctgggagccaaacatttgcagtttgtttgttttttcaaccttattcctgacttcacagtttgcacgttcatttgagggagaatcacttaaagattttgtatttctccatttttagaaccatggcatcctgtgcctcaagcaaatgcttttggagtattgctctttggaggcggcctctgtagccttgcatttgggtagcaaccctctaaaataaaaaaatagagcactgcaggaaagccatgtctctggtgtgctggtgaaaccaaaatacacaatagaaagaaggaaggtggtagcagcctcttaggggcattcccaggagtcctaggggccttgccaggtgctgagcacatagtagagactactgtccatgaagccagtgcctgggggatgttactgtttccctgatgggacctctggcttgcccagctccccaatggcccagcttcaccctcttcctctttttagcctcccacatgctcgctgctgtccaaagatgcttagatggatgtatcaagaggatcatggaagtaagtagcattttttaagtgttggggataagatgagtaactcttggatactttgtcctgcctctgcaacccaacaactgggagaagtgtggtagattgcattgtttgtctaaaaccattcctttctctctgcccttgctgtggctccccatctaagggaggaatacacttccccattccattgactttggccttggccatgtaactccttgaccaatgggatgcgagtggaagtgacagcatgacaattctgggccaaggccttacacagcaccatgtgttttcactcactgctcgcacacgtctgccatttgctatgaaaacaacatgagagacaccatgaccagacctgaacctgacttgaggcctgcaaacatcccagccaaccacagacctctacatgagaaagaaatgcttgtaataagccactaagattttgagcagtagtgtgctgactaatacctaggcaggccatcccatccacacaccctacctctgctgcatctctggccattgaaccagggtcttaactggaacacaacttggagttttgtgaggttagtggcagtcattggtgccacagcaccaactactgtagggtttctgggtacttaactaattaggatagcagggccagtctagaggtcaactggctgcctagtggtacattagatgcacagaaacttccctgatatgtgagttagaagaacatgcattaagtagtcactgtctgctagctattgtaccagctgcttaacaattttatctctaattttctccctacaaatgaggaaactgatgatcagataaattatatacataacctaaaattacagagcaaggtggaaccaggtcctttttttcccccgggtcttcctaagccccaaaactcatgttctttcccctctatgccttgaattacttcagggaaaaaagtcacactcaaagcttgtgctcttcccactgtatcccttacatttcattaacaaggcatacatttctgatggaaggcaggggtgaaagagcaggaagatcaggagatagaaggcagccagaggcaactttgtaatttccaattttaaccctgtgatgactccccataacatattttggtgaaatacatgggctaggcaaagaactacaggagccaggctgtggggggatctctgagttaggtcaggtttgcagtttcccctgagggtgaggaggaaccttggcagagtttgaagtgggaaaaaagtctgggcaggcctgtatttgcatccctgggtatctgggagagggagccttagagctctgtgcagagcaggtgctttggtgatgtggaaatctgtgcaacagcaggcactggtctgaggctgccacagtgttcccagcacccaggccagtgtcagtgctcaggcagctacaggggttagagagctgtgtctaaagaagctctgggatagcagagatgggtccatgtaagagtgagtagctctgattctgggacaaggagacagctgatggctgtcagagacccactagtgactcccccttaaagggagttcacaacatctcgaaaatgttctttgacatgttcttacctcaaagcccctgtcccttatagtattcactgtctcgttttaaggagtaaatttaagtcttcctaactgggccataaaaagttgtcattcgcatgatcactggcaatgactaagatggagcctttatttgtctttagtctgcacattatcagcttgacattttcttgatccactttggaaaagtatctttggcattttgtttgtgcaatgtagattctttttatcattatttttattaagtttgaaaggaaagagaagagggaaaaggagaggaaaataaagatgtttacttaagaaattgggttctggagagtaaagttagggttctgatttaaagttatccatatttaaaaccaacattacccggggttctgtgcagagctacagggcaggactggctgctgttcttcagctatgggtgcatgggtgagcttgacaaatccttcccatgcttttgtccatcctccagcccacccctcccaattctttgctttgagcttggtgattctaggctagtgatgaagaagaataagttggaaatgcaggggcaacttgtctaggaacagggaaaaaaggccaatgactgacgtatgagtaaaaggagaatcatgatggcctcggcatcccctcccctccattagaccagggccttgctgtctttcctgaactctacagcttaatagagctctgtcttcctcagaaagacccttctgggcccatggaaacatcagactgtaggattctagagactgaactctcaggccattgtgtatccttgaaggcagggaaacctgcaagaagggggcaggcagaggccaaccacacagatgccaggccactagagaaacatcatgaacattgttctgaagctgccttcaatgacatgtgcatgtatttgcaattccatggctaaggaagaaggagaaaacagggatggcatggtcccattttctactctgcagttctggctatttccaaaccacctgctactataggtaatagcagataagaagagcaaattgtaagaagaaaatataaaagaaaactcatgtaagctcagtgatgaaatgaatgtttctgatacttaacatttacctgatctttttgttgttcccaaaagcaaagttgtggagaagataaagtagtaagataatcttagggcagcagtcaccaacgtttctggcaccagggactagttttttggaagacaattattccacagactgggggtggggatgggggatgatttctggatgaaactgctccacctcagatcatcaggcattagattctcataaggagcctacaacctagatccctcacatgcacagttcacaatagggtttgaactcctatgagaatctgatgccaccactgatctgacaggaggcagagcccaggcagtaatgctcgctcaccagccgctcacctcctgctgtgtggccttgtatctaatagaccacagaccagtacatgtctgtagccccgggattggtgttggagacccctgccttagggtgtccaacctgaacagagttaaaagtcttcacaacatttggaagaaaaatgtgatgatggtctgaatgcggctgatatgtactttcagggtaccctttggaggagtgtcaaacaggtatgcctaggcaagtaccagcatgcagtagcacgcaagtaatggcaccccgttccaccaccctgcagactcagtgaggggccagatgctcacaagagaggggcttctcatttcaaaagaaattatctctgccctttatcccaaatggtccattgagaagcaaagagaacatctttctttcctgtttccccagagagcctgtttctcctcaccaacacctctagaacatccaagttcccagacagctgttggatccggcttgagagtctgctacaaccctctgggaggtgtgtttttgcctagaagttgttttgcccacctgtggtcaccatagcttccttctggggcctgtatacacactcagattccaaatgcatcttctttgtcactctgaccagcagaagtgccatttcacaagcatgatggggaaggcttgtccttggggtcactgaaggctggtgctacaattagcccttctgtttgcttttctgctccttacagtagagtgtcttagatgaacagacagggctccatcaataatgcacagatgctctgtaattgggacttcctttgatgttaatttagctaagttcaacgccattgtcagtgatagcaattacgtgcagccttttcaccaaggacattttaggataattttatttttcatgtgcattttaaaatatggcagtaaattttgagctacattacctgaattagaactcattatttattttcaacagtgaactaatactctgtctaggctccaaagctgtcttttttttttttttcttttttgaagtgggggatatgtactggggcttctactttatgcagtttttaactcttgagtgaaatttagaagtgagtcacctcttctttttttgttgagcattttgaattgtcacagaggctatctggctcggtgacctgtcacgtatttttgttgggcccatttttattcactcctcccccattccacagcctttacttttgttcttgacacaatttaaggagttgcctccagctgtttttctggggaggttttaagtctgaatttattgtagctgttgagttccatggaaaacctgcaattcttaatttgttcatgagctgttgttggatttgctgctccatttggggactgggcccactccaagtttcagggtaatgtttaggtttggattaaaggctggacttctacctcctgttattggttgccttattaaaatggggaatgtaatgccttccaagtctgttgggggattaaatgagataatctgtggcaggagctaatgcaggctctggtctaaagcatcagtagcagctagtgttcttagtcatgtaatttcaacttacaaggactctttttgtggcactgctgtgtcatcaagatgtgtgggtgaatgtgaggaaggtaattttggcttgagatgctggggggcaggtacctaagtcagcttgggataccataacaaaatgccattgactagatgtcttaaacaacagaaatgcattttcttgcagttctgaagtccagaagttcaaggtcagggtgccagcatggttgggttcaggtgtgggctctcttcctggcttgtagatggctaccttctcactgcactctccactcatggtggagaaagtaaagaaagagaaggagatctctccgtcttctgatgaaaccacagtcctattggattagggtctcatttaaccttaattacctcctaaagatattgtctccaggtagagtcccattgcagggtagagcttgaacgtgtgaatttgggggtacgcattcagtccacagcagggggcattgcccctctatttctggtggcttaactaagttttctggaatttatccttaaatgaaatacttctgctcttctgagacatctacttcctagtaagagtaaaatacctaaaagaaaggaatgtgagaggggaaagaaggcctcacattcatcctggggaggtccaggctcctgagcttgggcatctcctcagccaccgcacgagacccttttgttcttgtgggaatggtagagggaagcagtagggcaggtgaaggcatgggaggagtaagcatggcgtgggggacgggaggctccttgccactgatggagccaggagcatgaaggtgcagctgccctctggacagctgtggaggagagaggtctccatacaggaccaatgcgggaaaggatgcctggtgcagaagtgagcccttaagctctttcatttgagtgacctcgcactcaactctcttaatcctcctctaattcccttggcgaatctggaaatgaaggctgatgtttagatcctagaatttgtcattggaatcaggcccctctgcccccagagtgaaatgaaaaaactggggaatgaaatttgggagcttgttacacatgtccaaagaatattatcccatcatcagaagggttttgaaacccaagattgagatattggctctttagacaattagaaaacagccaagtactgtattatgaaacaaacaaacaaaaaaatctgttcagtttaatgctagaaaaagagaaagagaggttctaacttctgtactcattctaatttttagtcatgggatgttttggagaagattagattacaaaatatttttttcttctttgtgttcagaaaagcctcaataccaacttgcagcctctacacttttagatgccagaggcctaagctgaaaatatgaattgtgtttgcttaggtaaaaatgaacagggcgagtaagcggaataaagaataaaaagcttttccttctttgctttccctcccctcttcctttgcacattatatgactaaatgtgcaactttgttcacataactgctacaaacagttcactgtgtaggccaaacgctctcttatgcagtaaaattaagaaataatatgctttgaaagtgatttatgagtgtggttaaactgccagatttacaaagaaatagttcagatcttgggaagcctcaggagtcacgtcaaaaatgaatttgaccatgatttaaactgctacttttcttacatgacatttaatatgtgtactttggaggcccatatgtctttaataaaatagcattaagttttaaatatgatatgaatgcagccagtttctaaattcataaccttttccacaactccaaaatgctaaccaataagggagtcatacacgcaataaaacataaaccttagaaaatagctttttattaaaatggttagacagttggcagctgggttgcaatgtaataaatacttacagcattgtgggtttatcagacgttgtttaccctgcaagcaactgggaccagacaactaattatagcccctgccacaagagcagttcaagctgagtccccctgagtatatcgaagatgcaggatagtttgtgttgagggccctggacagggagtccagagatttgggctctaatccctctccaccacttaaaggggtgtgaccttgggcaagtccctccatttttccaacttctccaatctgtgtcacagagataataatgcctggcaggcagttctgcagtgctgatagataagaaacatctgacaccagtgcttggcacatagtaggtgctcagtaaagagaaacaattctttttaaaaacagcctttaattaaaaaaaaaagtattttaggctagaccttcatgtcattctagcagtgatgttttatgatgactctaggttggccccaagagaagtttaaccacttagccagagatcagtgtaaacatcatgaaaaatgaacatggagctccttgtctctctcacctcttgaaggaacaagcatgggagaatggcagaaggacatatttggttcagggggaatgggagtgtcctggtggccactgctactttcctgttcccagagatgaaagggaggtgtgcaacactgttccttcttgcctttggctttcccattcatagtgaaggtgacttatctttgtaaactgctctttatcacagcctaaggtctttgagtacttctgctgctgctgtgtgtgaatgcatctgcagacctttctgtggagtagtcttgaagtaggccttccagtctccatgtttccagatgcataggaacagctggtgtttccagcatcgcagatgaaacagccagtctggcagtggtctgattgtgtttgtccatgcaaccaaatcttaccaccccccacaaacctccttagcagggaattcctgaattccctaaaatggaagttgtacattatatttgagcctagattttgaatctcagggcacagacatatgtgtggttatcaaagatgaaaagaccaaggaaccacttcattttgttttgttttgtgttgtttttatattttttaacaatgttatggtttcattaagggaaattaacaaagaaaatccttcaactctattccctatatgtgactctatgacacatgtagggaatatgtgtgttcccttccaaaccgtatccttttctaaatgtgtttagaaatccttttctaaatgtgttcttgatgtgtttaatgttttactttttacttaaaatttttattacttattttgtattcctcaaatatattctttctatggactgtataattctctatcaagttgacctaagtactattagttaccaaaccattttcccaccgttcctggattttaaccttatgtataaaatactgctagttgtatgtatgtgcagggtatgtgtgtgtgtgtatgtgtgtttcctttaaattacttccttaggataatttttcatggctgggcttattgggtcacaaggtgtgggcacacaagcggttttaggctctgcctaaggattccagggtgccatttttcaagttggcagcctatcttggctgagtcattgcacctacccaggctagagggaatgtaggtcaaaaggaacacttaacatttccaagaccttctttggaaatgagtttcctagagtcttattggtgggtatggttctagaagcaaggcttagattctgtacaaagcatgcattgacctgctaagttgtagtcctagggaattacgggttccctagagcatcctgaaaattattagtggcacgaagtcctgatcagtgtgaatgtgccttcagactgtaagccaaatctttgcataataccaatcattctacctataaaagcacaaatatgttattgttctcaatagccaatttaatgcggctttggggaggaaaaaaagagaaaagaagattacaagctggctgatcttgcttttatttctcttaaatctatccacacttctcaggggttatacttgtttaaagattgtatgcaactgtgcagtctgtgtgatttggaaagcaaatcaaactaaatatgaagttttcagcatgtgctgtttttaaaggatttcatgcatttattccaaatatacatttcttcccaagtagcactaaacctataatctttttcttgttacatttgtttttcggggggtgggaggccaagagggtgacttagctttggagtggaaggttcctattaacatctacctccttcttgtgcagcattattcacagcagagctattaaggctaattattttcaggtttctatcaaagggggatatttgagctgacaaaaaaatgcatttattgggaagacaaatggcctgtttaaataagaaagggaccattatcatctacagcttccacccccctcccagttattagcctatatagggaggaggaaccagagacccatgggagactgtaagtcagaggaggttctgggggaccgtgctcactaaaatgcctggaaccccaagaagggaagtagattttcctatcatgtctgtagcccacctgaattgttcattgactttggagctggtgtcagcctgtcatttttttttcctcctaggtgaaattcattgacccttgatgtgttatggaaagaatattggttgaggagctacatgtattagtcaggggaaactaactgctgtaacaaacagtcccagatcccggtggtttagtcagtctccattcactgataactccttgatggagagtgaggagtgtccagggacctaggcttcttccatgcaatggctctgcatttttcttgggccttgagtccttcctgggttcagcccatggatggagcaagcatgagaacatggaggattgaacaggaggatccacagtctgggtttttgggtggcacacatcacttctgcccattggccaaaactcaggcatatgaacattcataactgcaaaaaagcctgggaaatgcggacattgtgcactgacctgtgtccgctcaaaactcatatgttgatgccctcacctcagattgtgactgcatttggaagtagagagcctttaaagaggtaatttagttaaaatgagactgttaaggtgggccctaatccatctggctgtttcccttataagaagaggagattaagacatgcaaagaggcatcaggggtgcccatgcacagagagatgaccaagtaaagaggcagcaagagagttgccctgtgcaagccaaggagagaggtctcaggagaaaccagccctgtgggcaccttgatcttggacttccagactccagaactataagaaaagaaaggtctgttatttaagccacccaatcaatgatattttgtatttcagccctggaaaactaatacagcagctcaaatgagtgctccaaaacaaaagtcagtgtatttggtaaacattgagccagcatctaccatactgagcacttgtgttttggccccactgcaatagtcagctactgtaaacccttgggcaagtctagtttgtcctccagggctcagattgctcatctgtaaaatgggtacagtgatgcagatgaactctgagggtctccctatggttttgtgacctggatggtgcacagtccctcagctggcatcttggtcaggtaggggtccagtatctggcctactgtggtggtacactgaaggacccagattttagggttcaacctggattcaaatccccactctcccattggctatgggattttgagtaaatgagtgtctgccttagttacctcatctttaaaatgaggttaataaaaataaatacctgaaagtgttgctggattaagggattaaaggaaataatgaatatactgtaaagtacttattccagggcttcgtgcccaataaagacttaataactttgggctgggcgcggtggctcatgcctgtaatcccagcactttgggaggccgaggtgggtgggtcacgaggtcgggagatcaagaccatcctggctaacacggtgaaaacccgtctctactaaaaatacataaaattagctggacgtggtggcgggtgcctgtagtcccagctacttgggaggctgaggcaggagaatggcgtgaacccaggaggcggagcttgcaatgagccgagaccgccatgccactgcactccagcctgggcgacagagcgagactccatctcaaaaaaaaaaaaaaaaaaaaaaagacttaacaactttgtatctcctcctctctctttctctttcttcttttttgccttttaatttttctgcatattttgtaattattttcatgtaagcatcctgaatgtgaagatagagagtgggaagcattgtcacgcacgtgatctcattttatcctcatgagaggataagacagatgaagtggagccttattttacaaataaagagcactaagatgggggagttgtgggattcactgacaattccagagaaaagtgaaagtgagatcgaacttgggcctcctcttggcccagtgctgtgttgttacatgatctctaacctggccattctgggtatttcagggctcaggagatgacatgattcaggaaaggagagctggagtcatcaaccaatgccaggtccctaaagttccctcaggaagcacaaaatggaaatggcagctctttcaagggtcgggcagacaacaaacaaatatgttgcatttatagccaggaatagaaagaacatggttaacctccaaaagttcctgaatccatctgatgaagatgatgttgacttgacctagtttgggaccagggtttacttttctttgtgctccacgttacctggacttctccacacttctgagagtcagggacatggcctcgaaacaatgtttgtcctatatgtctagcttgccacagctctcatcttcaaaccaccagttcttggttttatatacatggcagaagatgccccagggccaggagttcccatcccaaatcataggctgaggatgcagcaccagggccaggaaggaagggaggaatagagatgacatattcatgtcctggttctgttgaccatgcttgagcttcagagccaggcaccatcctcctacttagaggtgatggcgaccagacagtcttttaagagaaaaagtatattttgcttcacttttattcaaaacaagctttctagagggctgaaattttggatgcactagagacagctggagatcttcaagctataggaaaatgacaatgaattcagcctttctgctatctctttcctgtagggcaggttatctgtctttgtcatggctaatggcaatttatgctatccatgaccactgggaaagaaaaatattcatatttttaaaatgaactgagacagatcacttctctatcagggacatggtcatgctagaaggaaggaagtagagtttccaaggtcatagtttctcagtgttttctgggaggtcaccatttatttatgatcttatcatttgagtttcaaaattaggatgaattctgctggaaccttaaaaataatttgaagtgatgagggcagaagaagctgctcaaatcctgtgcttttcaggaaatagggtactttttagatttgccaagcagcaacgacattgtcacccagaggtttagctggaaggtaacatacctgaagcctcaagattggggcattttcaggccatctatgaaaatgaaatatcccaagcccaccattagtattctcaagctatgaaagaagatggtttaggtcatttctcaggccatgccctctggtatacttggcctggatatattcaacttgtattctcattcctacccctaactgcaatattaacattttttttttttttttttttttttttttttttttttgagatggagtctcgctctgtcgcccaggctgtattgcagtggtgtgatctcagctcactgcaagttctgcctcccgggttcaggctattctcctgcctcagcctcccaagtagctgggactacaggcgtccaccacgagtccggctaattttttgtatttttagtagagacgtgttttcactgtgttagccaggatggtctcgatctcctgacctcgtgatctgcccgtctcggcctcccaaagtgctgggattacagacatgagccacggctcccggccaatattaactcttgaacacgtgtttacacaggtgaccttcagctatttaagcacagacgttccataatggaagggcagcaccagaaattcccagcttttgagaaaattattggacctgttattactggaaggaggagaaccaagatgaggtgatttaggatatttatctagaagatgagggaattaatacatagaggcatctgcctctctttgcattccaccaaacagcttaaaaggaatttcagggctgggtgcggtggctcatgcctgtaatcccagcactttgggaagctgagacgggtggatcatgaggtcaggagatcgagaccatcctggctaacacggtgaaaccccgtctctactaaaaatacaaaaaaattagccggacatggtggtaggtgcttgtagccccagctacttgggaggctgaggcaggagaatggcgtgaacccaggaggcagagcttgcagtgagctgagatcgcgccatgcactccagcctgggcgacagagcgagattctgtctcaaaaacaaaaacaaacaaacaaaaaaaatggatttcaggtgattctttttggaaggtctttcttctcacccattggctagtttctacccattaacaccaagcctcagtttttccattcttcttcccactcattcatccatcttatatttactttgtttatcagggtccttggaaggatttgggtagaaaaggaactaaaacagccttagccttcacagggagcactttctagggaagatggactcaagtctttcctctgtctcactatgctgacctcttctacagttgcttgggtgcctacaaattttttctcctttgtgtgcctgatgaagtctacaaatgttatagactgaatattttaaataatttgacctttgtgccttatagtactcttattccctttttattgtcacattctgttagaatggaatgaacagaattcttcaaagggctttttagattgccgtttgatctgactgtggagggaagaatgatagagagttgggtgtgcagttttgcacacttctgggtgaatgggcagtatgcatgtcatctgcctccctccaggctgaccacatgggctcctcagggaaaacacagcccagccagggggagtgggggtgggtctcttcagatgtatggaagtccttgtgtgaagagccctatgtggctttcaacaataaagtctcattgagttggaggcagtttggaaaaaggcttggagccccacattagatggataccagaagaccaacatcccattataaaaagaaagtccttacatcaaaatatttaaaccaaagggaaaggcccaagaagtatggaaaagaaacaagaaaataagcaaaagtagtgaaagtatttccttccaggacatcagaagctagaccatggctctagtctagaatcatctgataatgatggagatggattttttgttcttaaaaagaatgctctggataagtcatttcatgtcagcttttataacagttaggagtaagggaagagacctgccttcatcttgccagtctttttaggtgtgttggtccttacctgccaggaatttggtaaacttcatagcatagagccttctgtctggggtatccgtggtcatttgctgccagctctaagttttcttttgtgatttctggcctcatttcccactgttctgcagtgtattttttcagtttaactagatcagtgtatgtctcaagttcttcttcctcctcctcctcccttcccttcgaaatagatatgccttcattattgttcgcccaatctcttcactcactcatctaccttctagggaatatatatctcaccttctttctctcatcaatccttcggtgcccaactcagattctgtcctctatgaagccccctttcagaattcccagaccccagagctttcctttaactacatctttaagccatattatattttcaaatatttgaatatatccatcttgctttcccaagtgagaaggcaaggaatgtatctcatctaccttctgtttaccccatggggccaaacttagggatggtcctatattatcccttagtatttagcatcttctactacactgagctatactgagacagtcaccttcttccccatggccaattaccagggaagacccaatgcaccagcactcagttctctcaccaagtgttattctgaaaatatgtgtatgagacagtggccagccttggaccagagggaaattctgcaattctgcaatttatgtggatgcttgctagaggtcacaccacaaggccactgtccacatatcagctttgtctcaggagctgactcatgttttttatataaatcatagtgagttgcccattataaacaccttgtaacattcaaaaggctttatggctgttattagctactgcagttgtgatttactagctaattcaggctgatgtgtagatgagtgtgcccagggcaccatttgtcccatctacataagtcagagagtagaataggctgggtactcaaaagcaaatgtctcttccgacggcctgtggcatgtcagggcttgcttatattttcagttagcaggtcagcagtctctcctctctaggtgggctgtgtcttcacaccttgacacctccatccaagagcccttggtgggaagcacggctgtaacagacagtttgtgttcagcgctttcactaaagacttccttattgcaggcagaaaagaaaataaagttgtgagagaaatatctggaatggccctggtgacacctttatgtttcccagtgcattcagcatcagattttgtattggcttctagttagcagtagtcacacttaccacttgttctttttttccaatgaaagtatctggcaggatgcggtgactcatgcctgtaatcccagcactttgggaggccaaggtgggaggattgtttgagcccaggagttcaagaaaagcctgggaaacatggcaaaatcctatctataaaaaatacaaaaattagccgggtgtggtggtgcctgtagtcccagctgctcaggaggctgagcctggggaggttgaggctgcagtgagccatgatcacaccactgcactccaagctgggtgacagaatgagactccatctcaaaaataagtgaaagtaacactattggattgcctgtggtgtgtacatttatataaaatcagatatagccacagattgtgtttaggatgacatatgttttacgtaacatgtttatttgtattaatgttttaggtttttgctttctttttaatcctactaattgcctaagatgagatgaaagaaaattcacctatacaagtggtattctgctcttctggatctgaaaacagggactaaactgagtaaaacttataaagtagtttgtagtttatttgacagggagaaaaattatagaaacacacatgtatataaaatgtgtgtatgtacacacatacatgcttaccagatgagcacattatatgtttatatacttactatatagctatatatgcatgttatgtaatacatatattaaacactatcccttactttgttgtatagatttctgctttgattggctcacatttaatagacaatatctcttcttagtttcagatttcggtgccatagaaccaagtagcttgggtaggaggtagttctttgcaattccaaatcctcatccttcagcctctaactacagttgactctcaaacaacacaggtttaggactgcacagattcacctacctgaggatttttttcaaccaaatgaagatcaaaaattgaaattctcgggatgccaaacccatgtatatggaacaccaacttttcatattccatagggccaactgtgggacttgactatgcgtggatctgtgtatacgcagggggccctcaagccaattccccttgtctatcaagggatgactgtactaagttgacctagaaagtgtgatatttgaattgtacccttgcctcaggcttgatttccctgcctgtcactttggggtgagctgtccaacatggcaaggtttgtcttctaaatggttgcatcatccacaaaatcaggaaacagatttatttgtatctgttgtagttagtgcttttgcccgtgggtttctggtgggaggagcgagaactaggcagcctttgtacctgtgactcaaaggaaataagtctagcattttccattagatgtttattgctcaccgagaattggcttagaaacctgtattgagttgttacaaggaataaagctgaatgagatcagactttggagaaatcagagaaatgtaaattaatataagaataaatgatcaccttgtacccattaggctgggataattgaaaaaccaggtaatggcaaacgttagtgggatgtggggttataggaaccctcatgccctactggtagagttacagtaattctggagtacaggctggcttcattgagctgaattaatatactcatatcctgtgcccagcaagtccactctaagataaatatcccgatgaaattcttgcataggtccataaggaagttcgtaggaggattttcattaatgtattatttgtagtggtagaaagttgaagccagctttgagttgaaggaaattccaggagattggaaggtagaatgtggtagatgccttggagtactgagcaacaattagaagcagggattcagtggatgcatggcaacatgacctagattgcattgactacatgtgcttgtttcctgtgcttttgataaactgacatctggggctgggctaaccagggaaagactgtccttcccagggctagccaattcttagagattgcaaatgactcacttagaggtgtgcctttgatatgcaaaggaacaaatccagagcccctgctgtgaaccacttcctctctctggctcctacactctaggagacagaattcctctgccctaatcatcccaggaccagtcaagacagccagtcctacttctgcttaccttgcctggcccatctcgtcccagaaccaccacagtcaagactttactgcctccttctgccttgttgcctacccagatgcttccatgtggggccctgtgtaacatggcatgccccctcctcttgggaactagagtaagctatgttttcaatggcagtcatcccctgatctgttggcctcaccacacctaaataattttataacataggtataaaataaagtcacttcatggcttggcacagtggctcacgcctctaattccagcactttgggaggccaaggtgggtggatcacctgagatcaggagttcgagaccagcctggccaacatggtgaaaccccgtctctactaaaaaaacaaacaaaaaattagccagatgtggtggcgtgagcctgtaattccagctactcaggaggttgaggcaggagaatcacttgaacccgacaggcgaaggttgcagtgagctgagatcgcgccattgcactccagcctgggcaacagagctagactgcatctcaaaaaaaaaaaaaaaaaggggctctagtgcatcttgtggggaagaagttggttgaaccttgtttaaccgtttgtttcccaagctcatttgaccatgaacccttcctggtagcacctacttacttaaatatgaagcttggtggtgaacctctcagggtacttgagcctttctttctagcagagggctttgggctcctgagcaacattcatgaacggaggaagactgtgtggacaagtggctagggaaaggcacaacaatttgttggagaagaagccattaactgagataccacctcttccttagtatccaagggacttggctcagtaggaatattatgttttttcttttcttttcttttctctatttatttatttatttatttgagacggagtcttgctctgtcacccaggctggagtacagtggtgtgatcttggcttaccacaacctctgcctcccgagttcaagcaattctcctgcctcagcctcccaggtagctggggttatgggtatgtgccactgcgcccagctaatttttttttttttttttttttttttttttttgtagagtcagggttttaccatgttggccaggctggtcttgaactcctgacctcaagtaatctgcccaccttggcctcccaaagtactgggaatataggcgtgagccactgtgcccagccatattatgttttttcaaaccagaaagatatttggttcaagtcatagttttcaatcattgtgacctttggcaagtcctttgaattcttttggttcagttttctcgttggcaaatgcagctttgaaacttaacttcataggtttatgttgaaggttaaaaatgatatatgtaaagtatctggcacttagtagtaggttagtaaaaattagccactgttaagacattattatcaaaattattaatatcttcatttgatcttttatgaggactaacagtgaacctattcacaattagccatgtgactatagaagtggcttactcaaggtcacattgctcattaatagcaggggtgggactacaatttacttctcttaggtccttgctcaatgtcatcttcattacactggaccaagggtccttttgcctatttcgtgactgaaggaactcagcacaagctctttcagtggactgaatggaccacttcattgcagcactggagagagatgcgggatgggattcagagggcctggggtgccactgggatttttgcttcagttatactctgcatccttgttaataacctagagaaggttgtaaagaatatgctcattatatctgtattttcccctaaatggagaggtattacaaaccccaccaatgacagagacgtgacataaagggacctggagctgtcaggcatatggacaggaaatcactagatgagattcagctgcaataaatgcatcctaatacatctggggacaaataatccgaaacacagatattcaatgggaggaagatatttggaaagcagtaaatgctgaaggggacctgggggatactggacagcaaattagatgtgggttttcattgtgttaggccaacagaaattggtaatgcaatcttgcgctgtattttccagcagtcccctggagcagctgggaggagaaagcctctttcaccagccaagatcaagtctgctcgccccacacactcctgaagaatggcctggctggggctggggtggagggaggggtcgctttactttcccctggcccctacctcacagggatggtgactttcctttctctaagccttaccctgaccctgtgtccttggagagtcggtctctttcctgtctcccagcgtcttgctgcagaatgctgtgggatgttggtctgcctgggacagccaagggaggacagtcctgcctggaaagtcctggtctgcagggaagacttggcctcaggtgtttgtttccatgtaagctaaacatagccatcttttctagtgatcctggcttcctccccgctctccctcacactcacacccccatcctcttcctcatgaaggatttcacctgcagatagcctctatagacagaggaatatttgacaaaacacaagcatctgccccagcagctgttcccagcaatggggatcagtcaccaactcctcccacctcctccttctcatgcttcactcttctgcaccaccccccgcccaattttatagtcttctcaagtttaaagacttcccttgacatgcataaaaccaaatttctcttctggggaccagtgaacacatattctgatttttttctagttcctcgccttaccccattctcaggaaagcccagttacttcgtgagttcagagcacttccttgctggggcgcctgctaagtggggtgagtttaactggagcacccctcccaacttttgggaaagagttcactctcaccaacccatactttctgcctttccttctctgggattgtcttacctctggaaatccttcagggacttctagggaatggctatgtcaatggggctggtaaaaagcagctgtgggctggtaaatgtcagaagctgtttgcaaggctgggaaaattcactgtttatttcttcaaacaagccctagtttcctccactgagaatgttcttcatcaaactcatcattcaggtttgtattcagagcagtttagcttaggcatgcaattgtcagtcaacactcgtaagtaagtggccaagtttaaagttactctttgaatatttctatacactctattcagtaagtgttcaccaagtcccttctctgtggctaccacacagctaaatactcatgtgtatatgtgtgggagagagagcgttttactctcgtggaggggcccgaatgaaaaaggcatcaccgtggaagaacttgagctttcagtcctgataggtcatggatataaatggatggcagctgctagcacagtgatttatgagtgatgctcccagccaaaggaagtcaggcacattctagaactgcagaccgctgtgtacagggcatctcagtatatttagcaaaatgagattgcaaaccacagaaaaaagggctgagtgggtggagaggaagaacattctctggccagaaacttgctgaactttgaggccagggaccggaggctttgcagaggtggggagagacgttctttggcttgtccgacagaaataaatcaccactgaggagatataccaaaggccaattatatggagtgttttcttggaaaatcatctcccagacaggccctgtaaatcatccccagcattggcagacattcagatctgcctggtggggcgggtggcatgccagtgcaccccagtgtcaggtagaggaattacacaggggtagtctcgttgtagcagggaaaacagaggtcaggtactagctgtcttcatccgaggaagcagtgtagggcagaactgtttgttctgtcctaggaattgtagggccaaggcttttgaccaggttttgccacttacttgttctgcgactttcagattctctacaaacagagtggggactgggttatctctgaggttcctagaagccctgacattaattttatgcctttgtgttctctataacttctgcatagcgtaagcttttgcataccacaccctatgctggtaattatcccaagagagacaaaaatttccatctacccagcaaggttagtcatacaggatcatcttgggagggtgattggggtccctcaaagccaggtcctcagtgtagctgtagagagagatgggaatttagcctggagaatgaagagctaagggggatgccagaggtactgtgttcaatattggaagggcttcatgtggaagagggatccgtgtctgttgtcctactctgtaggccaaaaacaggaccaatgaactgcaaatagaggggcccaaaaggaaggaaaagataaaccagcaatcattattccattgctcagtgacacaaactttgatttcctcagtgtttgaaaatatagcaagaactcttaactggccaaatgtggtggctcacacctgttataccagcactttgggaggctagagtggaaggattgcttgagcctgggagttcaagaccagcctgggcaacatgcagaccctgtctctacaaaacaaacaaacaaaaaattatctggacaaggtgtacctatagtcccagctacttgggaggctcaggtgggagtatcacttgaacccgggaggttgaggctacagtgagccgtgattataccactgcactccagcctgggtgacagcaagacacacaaagtctcacagacacacaaaaagaactctaaccatcagaactatccaacagtggcacctaaacctggcagagcggaaagtgatccatcactgctgtaatctagccgaggctgggtgacagtcatggtcacagcagagaggacaggatgctcctttctgctctatctgtaaccatcttctgtccctggaatgagctgagtgaggaatgctctccctcctctcctcaaagtatcttccttgtcccagcaaagcttcattcttcctattgaggaggggttcatttatctctaggagagttatcttaaaatttgtctactttttggagaaaatatatattgagactttgagggtgggaatttaattggttgccaataaacaggaaggccccaagggaaagaaatgagaattagaaactgactcacaatatctggatgggaagccaggcaggagggaaactcaggctctcgaaagggaaatctgttgggcacccagcttacttcttaattaccttttttgttaatggccagcccattccttatgggtttgttgttggtgggtttacttaaacctttttgaaatatattggttattttagcttgtactgattctggaggcaatgaatccacaaagttaataaaataattcttccatcatcttaaaattatttcttcattcaagcttcaagatttccttcttcttcccatattctagaatgaacaattgttttttctttatttatcttctttgtgattctattgattctgttgggatcccttctcagtctttgactttctttctagacaaagccctcctaattgttctcattagtttgagtatgacaattctgtccgtgtgattaattcaacacacacctaacatttattaagttcctactctatggaagtcgttgagcgagacactgaggctagaggtgaaaaagacacttttcttgccattctttatacaggattgtagcagaaccaaattagttgtaatgaatagagtgctatgatacatgatgcaaacactggccattgttcatgaggtcactttcatctacctcctgtgacagatgaaatcactgagactctgagaatttcagtgaatcactcaagttcctacagctggtaaatggcagagctggggtctgaatccagggctgtctgactccaaagcctgcatcctttccactgtgcaacacttccctttgtttgattgtcgatggaaatacagagaaacatgtgacttaagaatgagttggggaacttaattgcactggtgaaaaatgaagacattttataataaaacacataggaagatgaagtagaaagtttaccagtgtcctgggatcctccgcaaccactttgaggagaatctgagctcttggtatgcaggcttggaatcatggctctgtctggcgttggacataaaatggtagacttgatgcagactccagctcagtcatccttgtctgttatgcttggaggcgacagctctgcatgaacccattaactcagagagatttcggcagagcctttcccttccctgaccactgggcacgagtgcaccactctgctctgagctgatcagctttccatatgcacggaacaaccacagcctccctccccatctttcatcacctaaataagggcagttaatgtttaagagtagagaatagggaacataatgatggataaattataagtttggggatatgaaaagtcaaactgtgtaaatatgtattttaaaccacaaacagaatgttaatgcatctttcccattaactcactaactgaaattacagagtgtaacgtgagccaacgcccacgggttggttatgatgttttcagatttagaacagcaaatgataaatgcccttctctcagacaaagaagcgattgacacagcttttcaatgtagtcactggcaatgtcagcagtggaaaataaactgagcaccaggaggagagacgtcctgagatacctgcggaaagtggagtgtgggctactgttaagcacctcctgtatatgggggaatgtctcaggggtcggtgcagcccctccgagcagtgaggacccaggcgccattgcctggactgcctttctggattagagggaaggcttgttttctcaagcatcagctctatcttgctctgggttggtgggcagctgccgtgaagccagtttcactgtggctaggtttgggttggggatgtgtggtttttgcatcagccatttcattgtttggttgcttatgggcagcagtgtaaaagagaggttaagaggatgtggagaaattagaaccctcgtgtgctgttggtgggaatgcaaaatgctatggaatagtatggtggttcctcaaaaaaattaaaagtagaattactgtactatatgatccggcaattctgcttctgagtgtataccccaaagagttgaaagcagagtctctaagagatatttgaacacccatgttcgtagcagcattattcacaatagccaaaaggtggaaacaaaggaactattgacagatgaatggagaaacaacatgtggtcagtatattcagtggaatattattcagccctaaaaatgaaggcacttctgacacatgctacaacatggatgaaacttgaagccattgtgctaagtgaaataaaacactcacaaaaagacaaatatgattctacttatattcagagagacagtagaagaggggtcgtgaggggctgggaagagaaggaaatggggagttattgtttcacatgtacagagttttggttttggaagaggaagagttctggagactgtaccacaatgtgaatgtatttaccactactgagctatatatttagaaatggttaagatggtaaattttgtgttatgtgtattttaccacatataatattactgcatctttgtaagagaaggagaaggaatccagctttagggacttgggtagattcactgctgctgtttacttgctgtatgactttgaacaaattagtaaacactgtaagcctgctcttctcaactgtgaaataatatctgctgtaagggttgtaaaatagcgagtactcaataaatgtcagcatccctcactttggtgtttcagaaatcctctcttatgcccaccccaaactgttctcctgaaataaacatggtggacgtgtgtgtgtgtgtgtgtgtgtgtgtgtgtgtgtgtgtgtgtctgtgtgtaaaatctttgtatacatggtaagttatgcatggacttctttctgggctgaagtttggctctattaacgtttcttcacaaagatggattccttccctttgataccatctctgcactttgtccagttcccctgcatgtctttaattgaaggatcagaaagtaaatggggtatcctggagagactgcagcctgggcattgtatacctcacttcttgttagcctggtggtcctcatggcccttgggcagctcactcatagtcacttgggggtgctcagtctttctcatcccaccccaggatctgcctccctggtgcttcctccctgccatgcatccccctcccaccaactcccttcatccccaaactcccaccccttcttttagaggtagagtctctctttgttgcccaggctagagtacagtggtgatcatggttcattgtaacctcaaactcctgggctcagttgatcctcctgcctcagcctcctgagtagctgggactacaggtgtgtgccaccacatctgggtgatttaaaaaaaaaatttttttgtatagatggggtctatgttgcccaagttggtcttgaactcctggcctcaaggatcctggtgccttggcctttcaaagtgttgggattacagatgtgagccaccagtatccccctttcactggcttttgacactttcttggcctcttttggccctgagccaagtaaccctagggcatatttcaggaggaggttgttggcatttctgaagcctgtgggacaatttggctgtatgcaaatggttgagggtcattttcccctgaaggttaaatggtgaccctggtcaatgtttagctagtgtgcacttaaatgatttcccctagttaatgaatcataggacaaattagctgaggactttcgcaccctgcaggtaagctggggtggtaagaactggtaatactgaaattgtgttgagttatgtaggctatgcagtgcaggatctgcttagcacagctttccggtgcttagatcctaattacaaatgtaaattgagggctgcaactgttggagagccaccaaatgatgacctggatatacttatttctgagcctgctcaaacatccctcctcttcaccttaggaagccctatatccaatctctcttcctctatccctgtcattcccaaattgtgtgctgagactccccagagtgctgcagcagactcacagggatgatacgggatattttaaatgtttgaaggcaatacaaccacatgcaacatctgacagacgctatgtgaattaccatctcaggtgtttcacagtttcatcattagatcatgctacaattctttggataatactgtatctttgcaaagttgcataatttttttcggtagttgctgtgattaaaagcaagtgtgtatggaataggaaatgtggatggcagtgcctaatatgtacaattccaatattaaggaagttgtgcagggcccaataggtacacacatccctttagtaaacaagtgtgaatcttgaagaatgaaataaaaatgtttcctttcaatttatgcatttttttatcaaatggctattgagttattaggacataaatacttattaagttgttccataaaatggaactcaggtatttcttttggtccgtgggctctccctggaaaacattactgagaccgttagggcaccatgaactaagttggagagttattgttattattattttttgagatggagttttgctcttgttgcccaggctggagtgcagtgacatgatctcggttcactgcaacctctgcctcccaggttcaagcgattctcctgcctcagcctcccgagtagctgggattacaggcgcccgccaccatgaccagctaatttttgtatttttagtagagacggggtttcaccatgttggccgggctggtcttgaactcctgagctcaagtgattctcccaaagtgttgggattacaggtgcaagccaccatgcccagccaaattggagagttattatagacaaaaaaaaaaaaaagaaaggatcttcccctccttaccttcatcagtcctcccactgtgaactctcccttctgaacaaactcactgtgtcccttatatctctctttcttcaccattagctccttctcccacctgaaagatgaagtttcattgatcctttaaaaataaaagaaagaaaatcaagccttgtcgaatgttgttaccacctcctcttccattctcctttccttctcctcctccttctcctccatctttccctttccttcattgcccgacttaagaacagtcttgtcccgattcctttactgctcatatcatatccacattgctaaaaccttgtctggctttgtcccctgctgctgcctttatgtggccctcaccagggtcactgacaagttccaaataaccaacccaacgccactcatatatctgcatcatagtcacaataagctgaggtctcacgttcccccacctgatattttggcttctgctggttcctgtgtctagaacatctgcagctgtgttaccttctcattaataacagtggtgttgatagctcatcttgagtttccttctcccatagagcctctggggacctcaatacccccttaccacgctatccgccaaaatgctcagaggtatttgaagccacaggctgtaccacacagttttgtgtcctctgtagtactttcacacacagtaggaaggtagtaaatatgggtttgaaaggagcagcactgttcagaataggtggtccagactttggtctcccaggaacccctgctaacatatgctgaaagaacctataggtatgatgaggttggcttctgagatggaacgatagactccaaatctttctctcaacttaccaaatagagacctttctttctcattatataagtaatgcatgtgtactgtagataagttagaaaatgaataccaaggaaaggaataaagcttatatttagaaataacaactacttatacttgtatttttatatattaactgttagaattttatttccgtatatgtgaaagatatatatttatgaagtataaataggattatattttacttgtttctttatgatctccttttgttgcttaggaacactacatatggtgaaatagaatagatgaatttaataaaagttacatagtattttatattacactattgctcattattatttttaattttgaaaatatatattacatcattattccaggaaattatctatatcagtactactcaaaggtgtccatggactggtgccagtatgaaaattaatacaggtccatgatataagtacaggaattacgagtaaggcttcagaaacttttaaaggaaagtaacattcccatatctggtaactcattttagaaactatttttaatacaaaatattacatattaaatgcttattaacagaagtaactactattaaaatcattccatattttacacatatttcaccacctaaccaccccccagtgcccgcccagattttttcatataactgggaagccacagtccatattattcttccactggcttttttcacttagtaggtttctttccaagaaggtaccaaagagaaaaattgagatagaatctattgaaggttcttgaggaataatttacttatagtaaaatttacccttagtgtagagttccatgaaattaacccaagtgtagagtctggacaaagatgtctgataattatcataacaatcaagataatgaacagttacctttctggaaaattacctcctgtaccttagtagtcaaccatccccaaccatccctaccatccccacttcctggcaatgctgattctatttctgatcctaaaatgttgcctttttgagaaataaatggaatcataccatagtttggactctggcttcttttacttatcataacgcatgtaagatctatctatattgttgcaatgtatcagtagttcattcttttttattgccgagcagtttttcacatatggatgtactactatttgtttatccattcataagctgaggggcagttagtccagattttggtgattatgaataaagctgctattaacatttgcatagaatttttgtgtgaacatgaaatttgtgtgtggacgtgttttcatttcttttgggtaattacttggaagttggattgctaagtctcgtgatacatgtatgtttaactgtgtaagaaattgccagactgtttttcaaagtggctggctgtatcattttgcattgcttccagcaatgtatgaatgttccagttctactcacttgctatatataacttgatattgtcaatatctttttgttttagttttagtttcaatttttgcctttccaatagatgtgtaatgatatctatgccattgtggtcataatttgcattttcttaatgactaatgatgttgggtaccttttcatatgcttacttgggattcacacatcatctttggttaaagtcggttcaaatcttttgtccatttaaaaaagtgggttgtcgggaggcggagcttgcagtgagccgagatcgtgccactgcactccagcctgggagacagcgagactccgtctcagaaaaaaaaaaaaaaagtgggttgtttgattttttatattgagttttgagatttctttatatcatttagatataagtcattttgagatatgtattttgaaaatactttatcccggtctgtatcttcctttttcattttattaacagtgtcttttgaagagcaaaagttttaaagtttgataaagtccactttatcaacatttttcttttataagtcatagttttggtagcgtatctaacaagtcttggctaataaaagattataaagattttctcttgttttattttcaaaattttatagctctagtttttacatttaagtgtatgatccactttgagttattacttgtatatggtgccaggcataggtcatgggttgtttttgtttttttgtatacagatattgaactgcttcagcttcatttgttgaaaaggcctgcctttctcctgcttgcctttcatctttgtcaaaaattaattggccatgtacattggtctctatctttagactctattctatctcactgatttatgtgtctatcctttcatcagtattacattgtcttaatcactgtatagtgtattttgaaatcaagtagtagaagtcctctgattttgtacttttttgacaaattattttgggtattctagttcttttgcatttccctgtaaattttaatatcagcttgttaatttctataaaaaattttgctgggactttcagattctgttgactatgtagtgcatttttgagagaattgacatcttaacaatattgagtctgtgaagatggtatctctctctattaatttagatctttttataacttttaatctgttttataattttcagcatataaatcttgctcatactttgttagatttgtacataaatattgtatgtgctttgtgctattataaatggtatgagcttcgaaattttaatttccaattgttcattgctagtttcactttgctaagcttacttattatttctgagtgattttgtaaattgagattttttttttcaaattgacaatcatgttacttttatttttattttattttattttattttattttatttgagacagagtcttgctctgtcggccaggctggagtgcagtggcatgctcttggctcactgcaacctccgcctcccaggctcaaacaattctcctgcttcagcctcctgagtagctgagattacaggcatgtgccaccatgcctggcttatttttgtatttttggtagagatggggtttcaccatgttggccaggctggtcttgaactcctgacctcaggtaatctgcctgcctcagcctcccaaagtgctgggattacaggcgtgagccaccgtgcccggcttcatgttgcttttaaatagagacagttttatttcctcagtttcaattcttagattctttaattatttttattgccttattctaccacttagaacaacagtacttagaatcacagtaacttagtaccacaattccacagtactatgtaaaacaggcataatgcatgcagatatctttgccttaatcccagtcttgaaaggaagacagccaggctatcacaactaagtatgaagttagctatagattttttgcaaacgtcctctatcagattgaagatgttttcttctatctctagtttgctgaaagtttttatcattaataatgttgaattttgtcaaatgtttttctgcattcattgaggtgagtatatagtttattttctttagtctgtgtatatggtgaatttcattgattgatttttgaatattgaaccagccttgcattcccaggataaaccctacttggtaatgacatatttttaatattaatatattgctagatttgatttattaatattttgttgtagattttaattttaaactgatactaattgtacttattcatgtgatactttgtgatatttcaataaatataatgtatagtgatcagatgaggataattagcatatctattatctcacatatttatcatttctttgcattggggaaattcaatatcctctctagctatttaaaactatgtattattgttaactatagtcatcccacagtggtctaaaacactaaaacttatttcccctttctagccatattttcttcatctatgtttgtaattaatattggtctatagttttcttgtgatattttatctgattttggtgtcagtgtgtaatacgttatacaatgaatttaaaagtgttccctcctattttctagaagcatttgtgtagaatttgtattattctctacttatatgtttggtagaattcactagcaaatatatctaatgaatatagatacattcattagacatgtagttttttatcacttttgttgtcaaagttgtcagaagatttttaactacaaatacaatttctttaattggcagagggctattcagattatctatttccttttaggatgagatttggtaattggtgtcttcaaagggatttgacaatgccatttaaatacaatttagggtcctaaagtttgtaatattctttcattatcattttaatatcttaaatatctgtattagcgtcccatctttcattgctgatattgacaacttgtactttcttcttttttttcatattaaatctgactagaagtctatcagttgtattgacttttttttaaagaactagattttggtactactaatgtaaccgcccagcaggttcaccttacctgttgcctagacagagccaatttatcaagatgggcaattgcaatacagaaagagttattcacccagagccagctgtgtgggagactggagttttattattactccaatcagtctctccaagcatttaggaatcagagtgtttaaggacaatttggtgggtagaacccagtgagtcaggagtgctgattggtcaggttggagatgaaataatagggaggtgaagctgtcctcttgcattgagtcagttcctgggtgagggctaccagatgagccagtttatcaatctggatggtgctagctgattcatcaagtgcagggtctgcaaaatatctcaagcattgatcttaggttttacgatagtgatgttatcctgaggagcaattttgggagggtcagaatcttgtgccttccagctacatgactcctaaaccataatttctaatcttgtagctaatatgttagtcctacctacaaaggccatctagtccccaggcaagaaggaggtttgtttcaagaaaggtctgttattgtctttgttttgaagttaaactattaatataaactaagttcctcccaaagttaatttgacctatgcccaggaatgaacaaggacagcctggaggttagaagcaagaaggagttgattaggtcagatctctttcactatctcagctataattttgcaatggcagtttcattaatttttttaattttcttttttattttattcatctctgctttgtctgtcttaatttatttgttcttttggctttgcatttaatttgcttttatttttctactttcttaaggtagaaacctagattcttgatattctttactagtgtaagcattttagtgctataaatttccctctgagccctgctttagctgcatcccatgtattttgttttattcaattaaaatatattttccacattgccttatgacttccttttacctgtgttctttagactttaatttgttaatttcatatacttggcaatattccagatatcttttttgtattcattactagtttaattttgtgtggttaaaaaggaaataaataataaataaaccaatagtaataataataattttgtgttgttagataacacactttgtattatttaaattctgttaaatttattgaggtttgttttattgcccagaatactgtctgttttagtgactgttttgtttgtatttgaaaataatatgtatttttactgttgtttcatatgaggcttcataatgttaattaggtcaggttggttgatagtgttgttcaggtcttctatatcagtgtctactttattgattagtgagagaggagtgatgaagtctccaactgtaatcatagatttttcccttttttctttcagttttatcattttttgctttatgtattttgaagatctgttgttaagtacatacacatttaggattgttatgtgttcctgataaatgacctcttcatcattatgtaatattcttctttatttctggtaatggtgttgcagaactttgctccttagttcagctaaaaccaggttcttgtcacatgatcaggaaaagttaggcacacagacatattgaagggtaaagggaatgtggaatctattgggcaaaaaggaaaaaagaaaaaaaactctcagaaagcaagaggggttcctgctaacaggcccccatctcacagattgatttcaggccatacacaggaacggaagaggccaggctcctccccacctccacatgacacaagcttcccgtggcttcagccctttctcccagtgtgcaggcaggtcggagattccagggaccctctcccttatctgcctccaacatcaatcaatggcttttgctttatgggtgggtcttgctcattgatgagtcctgcctcagctgtaggagacctctgatagtccaggtctaggatcacttactgttcttctgcaggggttgaagtctttcattctttaacattttcctcagatacagtatgcccccagcatgacagtgtatgctacctctttcccagcaatttaaagcttttgttcttttaagggacaagtaattttgaagagctctctgcctttccattagtagcatctgctccctcctgtagaattgagggtagctttccctgtaccctagtcctgcccccactctttctctgtgagcacatagagaggtccttggaaaagagtggctgtgaacccctctgtgtctgcagttccagggattctattttctcatgctagtacatagttggccttcagcaatctattgaaaattttagctgaattcttcacatccaggcatcagaggccccatcttcctcccactggttcagttccctgctgggatcaagaaaagtaataattttacaaattatccagctctttttttttattgcatgagtgatattctctccagctttttatattcaaagaggaagccagaagtcctaataattcattttattacaaaagtatctatttatgaaggataggaaatttaatataaacaaaaactactgattgtttaagaagtgctagtctgtacctttatgaactgatttatattttcattctatgccacatcttggtcttattaggtccttgggtttgttacctggtagtaaggctggctttttgttgttagttctaaatttacatcttttgaaccaaaagttctagtatggcagaatttgctgactattcatgtattcacccttattatccccttttccttttaaaaaattttattgccaggcacagtggctcatgcctgtaatcccaacactttgggaggccaaggcaggcggatcagttgaggccaggagtttgagaacagcctgaccaacatggggaagctctgtctctattaaaaacacagaattagccaggcgtggtgccacacacatgtaatcccagctacttgggaggctgaagcaggagaatcacttgaacccgggaggcagaggttgcagtgagcctagatcacaccgctgtactccagcctgggcaacgagattgagactctgtctcaaaaaaaaaatgtattaagatgaaattcatattgaacatttagaagtgaacaattcagtgacatttagtacattcgcagggttgtgtgactgccctttctatctagttctaaacatttccattgttccaaagtcaagctcgtaacccacaaagcagtttctcccatttcccactcttccagcccttggggaataacaatctgcattttgtctccatggatttatctatttcttataaatattataaatatgattatgaagtttatatatttcttatagagtcttacaatatgtgactttttgtaaatgacttctttcacttagcataatgttttcaagattatccacatcatagcatgtatcagtatttcattccttttcatgactgaataatactcctttgtatggctatatcacattttgtttatccattcatcctttgatggacgtttgggtgtttccatcttttcactattgtgaatagtgccactatgaacatatttttattgcatctgtttttttaacttttattttagatgtgcaggttttttacataggtaaaccgcgttgttgtggggtttggtgtacagattgttacccaggtaataagcacaataccctatgggtattttttctgatcctcttcctcttcccaccctctaccattaagtaggccccattgttgttcccctcttagtgtttgcgaattctcattgtttagctcgcatttataagtgagaacctgcagtatttggctttctgttcgtgcattagtttgcttagcataatggcctccagctccatccatgttgctgcaaaggacataatctcatttgttttaatggctgcatagtatgctatggtataaatgtaccatatttgctttttccatttaggtcagttccatgtcttttgtttttttgtttgtttgttttgagacagggtctcactctgtcacccaagctgtactgcagtggcgcaatcatggttcactgcagcctcaaacacctgggctcaagctattctcccacctcagcctcctgtgtagctgggactataggtgtgcaccaccatgcctatctattttttaaaaattttttgtagagatagggtcctctgttgcccaggctggcctttaactcttgggttcaagcagtcctcccgccttggcctcccagattgctgggattagatgtgagccactggcctgaacatgtcctgcttgagtacctgttttccattctttagggtatatacctgggagtggaattgccgggtcatgtggtaattctacgtttaatgttttaaggaacctactatctcctttgactataatttttgtcatattgctctttgagtttgtcttcccagagggccctaacttttcattattgaagtaagacaggcaaggaagtcatctttctactagtttcatgtaggaacctttgtagcttctctaaagaggatgatttttttgggtctcctttaagactttcctagcaatttcataaccttcttggatggaagatacaacatggcaaaatgcagttgaggataaagaggttgtttttaacaataagagccctcttgaaaagtcatgagttttgcatgacaagaagtgcttccagttgccagtgggagagtttcctcatcatgcagagtggatgactcactgcccttgactgctcttctgatcccgggggcctctgttctctcacagtagatgcagcacacagagctgccaaggcatttccagcagggggttctgtgctcaggttttgaacaagggcagcatgatggagcctgacttactcatacacttcctgaggttgatgaacacattttcaccccttttagttgtggtaggtaatgtattcataaattcaagcctttttcccagattgtaatggatagtttatatctctctcatgattatttaattattcaagccaggatgactgtgtgttttctatcagagtttgggctgcctcagcaagatgcagactggtatctgcccttaggttaaaaattccggccagacatagtggctcacgcctgtaatcccagcactttgggaggctgaggcgggtggatcacgaggtcaggagttcaagaccagcctggccaagatgatgaaaccctgcctctactaaaaatacaaaagttagccaggtgtggtggtgggcgcctggaatcccagctacttgggaggctgaggcagagaattgcttgaacctgggaggtggaggttgcagtgaatggagatcatgccactgcactccagcctgggtgacagaatgagactctatctaaaaaaaaaaaaaaaattccacaccattcccttcttccaagtatggatggaatttcttccaggatctgccagcttttgtgtgtgtttgtgtgtgttgtgtttgtttgtgtgtgtttgttgaatgtctgtctaccactagaatgcaaggcccaagcagggaaggaccatggctcttctaccctctgcagactctccagggacggcactatgcttgggtgtgtggcctactccctatttgtcatcccagacctatgttttactcttctttcccttgctctgtgtcctggggtgataatgccttcaaccaccaggctccattgccctctggcttctggttgggtttggacaatgagggagaggtagggctacttcccctcccattgccacctgcaactttgtggttctggctgtgtccatccaggactatagcctttcatgccaggctgccctccctgcagctctgggtctccctgcagctctaggtctccctgcagctctgggtctccctgcagctctgggtctcaccgtgtgtcttggccacggctatctgctctgggtagctctggtgcttcagtgtccccggggttcctttgatcttgcccacacccctgtaaagaatttgttcttttaaaatcccaggtgaatatgccttctctttcttgccagggtcatgacaatgggctgaatttttgaatagatgagtggatggatgagaagacgaagggccgtgtttgtggctcaccccccatatggaacccccctctggctgccatctcactgggaggccttgccctgtctcatgtccctgctgcctttctcctgcactcccctttctcaatctgtcccaaccatactggctccattgctgtttctagaatgtacaaagcaagctcctgctccaggcctttgctctagccattctctctgcctgcaagtgtcttctctcagatatccacttggctaattaccttttctaggttttgctgaaatcttaccttttctatgagcctcacccaaaccactgtatttaataatggaaactgccctccaccaatatcaccttggcagccaagggcctccttcatcttggtctgtgtttcttttttccagaacacttaccacgttttaagaaactgcatttgacttatatatttattgacataaatattatgcttaatatttatcatctgtctctacctgctagaatttaaactccaaaaggcaggatttcgttaccgtttttttccatgggtatattccagactcccagagcaatgccatcttcacaataagtgcctgtgataggttgaagagtgccttccaccccagaagatatggtcccctggaacctgtgaatgtgggcttatttggggggtgggggggaagagtctttacacatgtaattaagttaagaagtccaaaatgaaatcttcctatattagtgtaagccctcgattctaggaaaagttcttttaatagaagagacagggaaacagacacagagacacaggggagaaggccaggagaagacaggcagagactggagttatgtagccccaagccaagacatgcctgaagccaccagcaactggaagcggcaaggatggattctcccctagagcctttggagggagtgtggccctgcagacttcttgatttcagaaacctggcctccggaactgggaaggaataaatttgtgctgttttgttttgtttttttgagatagtcttgctctgttgcccaggctggagtgcagcggcatgatcttggctcactgcaacctctgcctccccagttcaagcaattctcctgtctcagcctcctgagtagctgggactacaggcgcatgccaccatgcccggctaatttttgtatttttagtagagacagggttctgccatgttggccaggctggtctcaaactcctgacctcaggtaatccacccacctcagcctcccaaagtgctgggattataggcatgagccaccaggtccagccaagtttgtgctgttttaagccatcaagtttgtggtcatttgttatagcagccccaggaaactattagtatagtgcccaataagcatgtgccgaatgagtccacgcaagccttgttaacactgatatgacctccatttgaaataattcttctgcttttaatagctaccaatgcctgttagtaaatgtgagtacgtctgacatttaagcagtgttccagtttggggtatggtatggtccatttttgcagtagaaacttaaacttcctgaaaattttcacccactatgcttaacagcttaaagtctaacctaacccccaaataattgctttcactgtaaacctatcaatagcgtatggagaatgaactcacaaattattggttcttcaggcagtggatgggaacccctgttggtctttagccatgaaatatccctgtatcatttccccatttttatcctgagtccctcctgctgtatttaagctaattctcagtgattgtgtctttggaggagtccgtcacaagcatctatgtgatcaccctttgtatacctgacaggggttattttttctcccccaggcccagtcctggtgcgtgctgggcttgtgatgcagtgtggtactaactatctgctccttgtaggagacggaaggtaaatcaaattgaaaacacccttcctgtgtagtgcgtcttccaaatgtcctcaggtctctattacatcttctggaggctgccagattctctgcgggacaagaggaagctggagcagcttctctgtagcgacagaaggtgccattagcagaaatacatcatctcccagtggtgctagcaatagcagagtcctgatcatgtccattcttttgccagactgaggagagagtcctcagaggcaggggctgctggtaacagcgcctccatcattctaaaatattccccctggagtcccagagcagctatttctgcccagacgcaacgagagcttcacagagcttatttcaggcattgatctttcacaaaagcctccctgcttcctagattccaggccttctctagaaggggtgggggaggtagaggcctgcacatggctgatcagttgctctggctggggctggatcacttcttccaggtgttgctcattagatctcttttcaagggaaatctattagcctggagcagtggttctaaaactgcagcttgcagggcttggtaaaacaaatttctgggcctcacccctaaagtttgggatttagtaagtctggggtagggcctgagaatttgcatttctcacaagttcccaggtgatgctgaggctgctgacctagggaccacatttcagaaccagcggcttagatgcagagagacgatgttcttgtgttctctcctacttagtcttggcctcagtcctcctacttaaggcagtctgggccttttgaggttgggccaggccctgtctcaccctgtttctggaatgcagtgaaaacagctcttgattctgtgcagcccatctgtgctagttacctctgtctcccaggagaagagagcaatgaaccttcttcctccatggctctgtttccgctgtctctgttaacactgtttcctcccccttggtcctttagccctcacagcttcccccttttgctggtctctggatgcctcaacatacctgtgtggctcctctgaccctgtcctttaaatagacctttctttttattttattttacttttttgtgaaactttaagttctgggatacatgtgcagaatgtgcatgtttgttacataggtgtaaacgtgccatggtggtttgctgcacccatcaacccatcatctaagttttcaaccagcattcaagaccatttgtgttgaattctggttcctgctggtaccatgtcctgggatatttcttcccttaggggcaaagagttttctagacagactgagtcagaatcacttagtctttatctcaagagcagccttgtcacccacagtagaaggcagaattactgtggagtctaacagaaattagggaagtaagaaatttataccaaatggaaatatggaagatttatctcacttatttcaagcttggggaaatactagcctttaaatgtctgattactagagcctgggaataaagagggactgcttaacctagggaagtggtctttggtaattgggtctctgatccaattgatcggcgaacaaatctgtcatcatagagtcactggggcagctaccctcggcccaactctgctgtaggtgcctccatgacctgactagatgtagttgtgaatggagctgggattgtggagggacttcatatgtacattacgcatgtgtggaaaggtaaaataaccatcagtcttccaattagaaagccagaaagctacctgggacataatcaatgagggcaggcagattcacattccatttgggtgtgcaagggtatgtgtgtatatacgtgcaaagataaacacccctacacacatcattaaagaaaagaatggaaggaaaatcacccagatgttaatcatgtttttctctggttattgcaattacagatgatttttgtttcctatttttctgtgttttctgtttttattcaatgaaatatttttattcttccaaaaatatgttaagtgtggcataggaaatagagctcagtgccctgccctctgctcagcacctatccaaatcctattaacataccacatagttcaggttctgcctcctccaagaagactttcctgaccagcctcttgctgctaaattttggaaatacttttgctgagtgattgttcctacattgagtatatttgtcttatttcttcaagtgcactgtgacttatgcaaagatactttttctgttttccatttcccacaaggccaaatacagctgaactcattgtagatacttgttctacaatgggcagcgaatttctgaaaggatagaaaagatgtgaaaatgtgaaaaacagaccaaaatgccatttctcctcactcacatgccccacagtcatatctcaacttggttgtagctctccctcgctgagaggtcatgacctccagcttaatgtcagtgctgtagggccttagagcacatctcctggataacagtgtgcctgcgcatgggctgtgtatttctcccctccttccaaagtggtgagcactttgcatcaagcgcaagaaagatgtttgatgaccttaatagcattagtgacaaggcctccatccttgttgggcacttttggtctgctggtaaaagaaatgttcactctatccccaagagaaatcttcttttccaggaatatacagcaaaatcaatcaagtcttccccctattgaaggctagctactccacccatgtgatagatgccatcaattttttcgtcctctggggaaacagagtcattttttccttctttatcttgcatagtcagtgctcccttacaacacagtaattcccatcaggttttgagaactctgtcttctccctttaagcaaccaccctaccagaagccctcttcagttctttctctttttgctttagtgtcaaattttcaaaagacctgtctattcctgtactccccattttgttaccttcaacttattcagcgattcagtgcagtgtgtatcagcgcagaatttggctccactattctaccattagcttaattccctccatgttgctaaatccaatggacctctcagtgcatatcttatttggctttttgctagtactataaacctttgttcacctcttctttttcgaagcacagtctttccttggctttagtgacctatgtggcttttgaccacctccctggccactcttacatcaccatctctgtacaggctcatctacatttacccagctgatcaatgttgaaacaccttgggactcagcccaaggacctctcttcgtctcgggctgtactttctttcttggaggcctcattcacatccaggttttcatgggacagccacagtttgaaagtactcagggatgtgtcctctgaccaccagagaaatatttgcctctgccttcttgacatgtctcagacgcctcaaaggtccctcttgttcttcctgtgcatggccagtcctccttcaaggacctctgagatctcagcaaatggcactgtcacccctacaggtatgcaagtcagaagcttgagttggccgatctgttccacattctacctgccacactgcctcagcatttctcaaagccatccactcttgttctttacttctgtcacccaaattcaaaccatatcatgttcatggctttcatttttaaaattctggactattatagtccccaaactagtcttacttccatcagcttttgaccccttgcagtctactctgcttccttgaacagatctttgcaaaatacagacaaatcaggtcatcctcctgcttcaaaccttgcactggcttagtcttgcttttagggtgacagggtttggctgtggccccacccaaatctcaacttgaattgtatctctcagaattcccacatgttatgggagggacccacggggaggtaattgaatgatggggccccgtctttcccatgctcttctcgtgatagtgaataagcctcatgagatctgatggttttatcaggggtttccacttttgcttcctcctcattttctcttgccgctgccatgtaagaagtgccctttgcctcccaccatgattctgaggcctccccagccatgtggaactgtaagtcgaattaaatctctttttcttcccagtctcaggtatgtctttatcagcagcatcaaaatggactaatacatagggtaaagagtgtattcactaccatagcctgcaccaccatgcttcacctcatcccactgcctacagcccagctccatcttataccatcagcatccctgtccctaccccctactcatctactttttagtccctctgaagtgtcattctccatccacaacgggcctttgttcattttgtttttttttctctgcatgccacatctgaaatcccttctctcagtaacctaaatcaactttgtccttctcatcctccagttcttagcttgttatcacttcccctgggcagccttcctccaagaccagaccagatcctgctattttatggatcctcaaagcagcctgtacctctccttcctagcccttgtcacctttgtgatttaacatgtctttatgtgttattttgcttctctgcttccttaaataagctcctcaggacagggaccgtatcttttttgctcatcattgatatccttagcacccagcataatgcttggacgaagtccgtactcaatacccatctactgaatggaaaagactttggcagaagaaaatgaagtcaaccacttgctcctcagacctgggtcgagcaagccaccacacctaaatgttcaagttagaatcaagaaagttcatttgaaagtcatgattcaggtttccagcataaattatatgcagttgtgcaaacatgtcaaagtttagtaaattgaatttgtttaatgtaaacaacttttgaccaaaataataacacagctttagaaaaagacattaggcacccacttttgaagagtttgtataatttaacacacaagaaaactttactgtaattatatgcagacgtatacaaaggataaatgttatttacttgctccaccctccataaaataaacctccaaccatgcttcagcttgctgcattaatcctaatttagaaatcacccccgccgaaatgggggtgggggggggcgcatggtgggctctcatcttttcttcgcgtcaaaattagccgtttaaattagaaccacgttgggagcgtaggtgacgccaacgttgcggcaccagtccggggagcacttaaaagtagccacctgaagttaattaaaaccttacctgtcaaacccagtatggctacatttgaaaatctttaatgtaattaagagaagcacattatgggaggtcaagtgactttctttttgaattccacttctaatctgtcgtcaaatggatggaaattgccggccgagggagttaatgaaagctgcatgagcgagcaagggagcaggaggaggggctggcagcctggaggagctggcgggagggcggacggggacccctgtctccttctagcggcgaggaatgagcctgggggagccccaccgggcaacttcccttctgccaggaggctctgggtggggggttcattcagcccctctccctgagcacactgggggcatgcaggagcagggtatggggcgtctgcgcagctccctgcttatcgctaagtgagatctgtggccaggacggcggggcctggacagagtggagccggcgccggccctcgtcacccttcactcagagccgcctgattagcatcagggttccgctcgcctcttgcacggatcccccaaagagccggtggggaggggggcgcttccacgcggagcctcagctgtgcagcgcctgaccccaagcccgtcagggggaaggtctcccaggtccgcagccttcagcaccctggatctggggaagccccaagaggccctggtactgccctggattttcttctgggcatgtgggcttctgggccactaaacccatctcctactgcactaggtaggtccggctcccggagcccccagtgcaatcttaatgccagaacgctgccttttggagattaaatcacttaatgctttgctgtgtgttctagcctgagggtgctgttgacagaaggcagagtttttctctctggttgctgcttctctctctcttttttctttttgcattgcgtttgtctgtatcagcagaggtatctgtgtttgaaaaaggattaactccctcagaatgttgccacttaagttttgcccctgccttggaaactgacatgagaataaacaacatattaagtcttcacagaacactggtaccaagaagtttccaaaccagaggacttaacctccttaatccaggccttttccctttgacttcctcctgttagtccgagcatgggcagaaggcatcagtggggagaggagtgtaaatcttctagtttggaaatctcttccatactccatggaaaacattgggtgtctcctgtggggccagtgtggtgagttacttggaacagaatgggcaatctagtaggcgttgaaatattcagaagcatctcatagtgtcttagaagatccaagacctagcccgatgggtcttctctgttattagaattgtgtggaagggtggcagacgcagttgaggggatgggatgctgagagacaaggcatttattaaaacgacctctagagacttttttttttccactgggcttgaatttcttgggcttggagagttgtcactaccccatatgaaaaatggaagagatgagtgagaggaaagaagatgaggggggaaaaaaccaacctgagagtggtttaaaatcagaacagagtgttggtgagagtcagtttccaagggtcgcctcttcatgctgtattgctttttcttgaccaatgaaaagccccctttttcagatttccccccatttctcatccatagcagaaagggcagtgcttctagaaattgagatgtgtctccaggtaaaagccacacaaggcagtgggaagggatgtggctgtccccagcctccatttgatgccgcgtttctctcccagccacaagttcacaggtaaaagtgaaaagttgctctggacgtcccttccaaagagagctgtctgctcgccatggcaaccttttcctggggtctctggctgtcaagaacggggtgcaaagttcacagagctcagcattgtgccctcctctcttcttgtcccttttttcctgaagggatcgaggttggtttgcagcacagtttaaagcgaagatgccaaatgaaaagttcctcgttttaagttggtgcttatacaaagctgctttgtggtttttttcggcctgtcagacttgtcaggcctagtaagaaaaagtatattgtttccagcacttggattcctttctccctgacatctgccactctgtaaagatgataaattcctgcctcattagccaagggtgtgggattacaggctgacaacacattaatcaccagcctctgtggcaggctgactagcaataggcattgttaacaaaacttttctaatatgtcactcttctctatgacagcctgtaatcaatcattgtgattgacggcgctgatagattacactatttatactttgtgtaatgaaagatagtgtttccacctactgtcatttctgggctagtggtagaggatcagtaaatggaaacaaacataacaacagggcaagccctcattcaccccaaaatatccatagaactaccccaccttcccaagtcctaggcttggcttccacttttggaagtgaaaaagggcccatcctggaactctggcaatcattctgggatgaggggtagtggtgggggcacctggaaggacagaggtaatttggattttcacagagagagctctttgcaaaggatacgatcccaggtattgataggtcgagtttacataggtaggagagtccccaagcagcccctttccttcccctcatcagcttacgtgtgtgcagctgagcgttgagtgcctcctcccctgccagatgagagatgatttagatgttgataaaatatttgttctttcctggctctgagggcaaatattatctttgtttcccataatcgtaaggcgctgcaaaagtcaacagcacccagagcaagtacaaaaccaacactcggagagaagccctttctggaggcctttgccagggcttgcttgtcccccctgaagctcagaaaatttcaaacaggatacgaatgaatcagctgagctgaaatgtgttctgactctcacatcctcggtatttttggagggtcctttcagtcatttttattttggtctggaaagcattcgtaaaggatacaagctgtttttgctttgctggaagttattatttcaatagagtgacaaggaggctcctgggctagcatcctaagaggggagcatctttcctcgtgttggggccatttccaggcaatttggccacaagtgcctgttttaatgaatcactttaaaaatgattgtggtatttaattttccttactattgattaaacacaagaaaatactcctttattacttctttaaggtggttagggagattgctcataggtatataaatcttcatttgactcttcagtacaagcacagatgtgcgattccctgccttcccattcaatgcatttttgatctttgcgtctctgcattatatgtggattggcgaggccaagagaggagagtagtaaggaagcagagtcgtcgtcctcctcctgaacgctgtggtgttgataggcatcagacactttaggtcaccctgccagttggcaaagcaaaaggaacctgagacctacccctagtgaaattgccttagaggcggatgagatgggaggaggtgcagggagacagggagctaaactttaatctctctgtgaagtttgagtgagcccaggatgattaatgagagagcagaccatctgattaagcccctctgtgtcatagaacatgattagtaggtgacagagatggtaacagtatccagccaaacccttgtttctttcacagctccggctgttatatgattaatgtccccaagggctatcttggggtcaggcaggggaacctgtcagaacaggtggaagtgacaaaatgggcagaaactcctaagggggactggagtggtgagggagaaaatggagggggcagggcagccagatggagccggcgacctttctctgatccaagcaggcacagagatcatcgtgggaatggaaacgaggaagaatcacaaaactgcagatgtttcccaggtcctcaatgcatcaagtactgccagctcagacttgtgggaagcacagtgtgacacggcgcgttatcactcgtggtttatgttctgagatggaatgggatggggccactgcaggccctgtgggtatgaatgtgggatgcccgcacctgtgcctgtgtaagcatgagtgtttgtgcaggtacactaggacaagtgctccactctgctgggggattaagtatgtatcaaacgggtagagctgatatttcaatttactgctttctggggccaacacctatacattgtcttgactgtgctacttagaaaagataatatgggaaaataacatggatttacagaattgaaagttttaattctgtaaatttacagaatcaaaaggtttttagatttaaagtgaactgtagaaatccctaattcagataatccagattacaggtgagaaatctgaggttcagagaaggtaatgacttgcccagtggaagtcaagactagaaccccaggcttcctatttccggtttcatatactaaacccttgatgagtctgttggtaggaagcctcagaccttttcattagatgtgagtttcccagcaagacttgagtctttactctccttatcatattccctctttcccttcctagaagcactttgacctcccggtcaaaggtttaaacctcagttgaaatggagtctcattaagtccttttgggcaagcagccttcccagatgtcaactttgagaggagactatgctctcaaggcagccgttttgattgacaggagtcctgagggtagccatttttacattaaagggaaactggtttgtattgagtttcatctggtgagcctggcttctcttcttccacctttgatgccctatgtgtctgttacatacattcaagagtcattcccgggctctaatggggtctgggagaactttcatctcagccattttccagggctctcttgggtaaccagtttccctttgttattcacgtctatccaataactcttgctcttatgttcacacaataataataataactgggttagaacctgggctgggcagtgaccagccccctacatctgcttgatctctaatgcaggagtttacaaattggaaatctttgctagctaggaaaaagatcaccttgcagtaggattttatccataccaacagtgctcgtgcttcagtgagttgcaactgtggacttaatggcaaagctgcactcagtgttatgatcacgaaggagggagaaggaagaatggagattgtattggattttactaaattgtgtcagtgagggagtaagttgaataagagacccaaccagggcatattcataactctgtctcctgacagtggttgattatgtacaattttgatgttgattatctttaaatagctcttcttgttgtgggacaaactgggagatctacctcacatgagggtaaagtacaaaggatactaaaatcttcccagagtagagtccccatgattctgtagcataggctttgggggatcaattatggataaataaatgttcattagcttcagagctctagtatatgatttttgtcatgggtttcacctcagcatcatacagcctttccaggccaagaagagaatgacctagtgctccaaaaacagtcacttaaagactggctctgtggccttcgagtgagttatataaaatacaaccaagatgagactgagtgctttccatggtcaaagggaatcatctaggaccaaacttttctgtgagctgatagaaaaatttgagcaaactttggcagactgatccaagaagatacttagcctttactgtagtattcaggatattgtcagacattctggtgtagtgtggtggtggtgaagtggtgatatgttttagtacagagttcattggttgctttggaggatcatgaagtgcttgtgcctttcccctattgctatataggctgagatgccaaaaattcaggctttcataacccacaataaaacctcatcttttccaagatgttgacccattccctctgtgcacactgctttatggtagagacttcctggtagagccatgctgttgtggaggtgactcccagctttgcttttagtaggccctaaggatactttggggtgtcaccatgactcactggtaaaatttgggaatcattttatgagagaggccacaagcaaatggtgactaatgatacagtactgaagtttgtgaatgatgtacattcatgtaaattagaccagattcactttggctgccttcctctgtaatttcttgagcagagagagaggagtggagttaattaacttagggagaatcacatctcaccttaagggagcccttgggagtgggttgggctctataaaatcatcctccaagcacttgggcagagacatgtttgagaacttctatattaagatatagtgtgctaatgttattacccaatcagagtgtgtgacaaatagtttaatgaagaacagcaaatgttctgggtagcaggtattcctttacttaaaggcgaagatgagctatatttaaaattcaggaaatgcaaacttaggtccatttgaggctaatacatacacaagattctgccttttcatgacagaggaaaacataagaaaaatgtagagtgcaggagacattcatttatcttggaggagaagaccattctgtggccccatcagcctggactcccaagcccagggtaccaagccctcttattcccttttgcattaaaaacatcacaatcatatcttttttatcctgttatttatttttgagactctgaaaatggatttcttttgtgggtggttgtttaaagaaaccagcacagaaaaatcagcctgtgcaaatacactttttttttttttttttttttttttgagcagtgattttctttttgtagttcggaacttgaggcgaatgaaggtctccctggtgccctggtagctgcagcccctcttttagcattttttcaaagggcgcaggccaatctgcccataatgagcttggaaagtgaggatgaagttcctgataatatgacacaaatttctttacttttgctccttattttatcttaattagtccctgtagaaaggattgatttttgagaggcttgtagtgaacatctgttggtattcctggggtcattcttagcctgtcctgtgtttgacatttcttgtaaaagaggaggcatttgttcatattgacattagctgcctctgtatctctcggtggtacagatggtctgtgaataaagacatcaagctaataggcaagatgacaagcttcaatggagccaaggctcctcacacttaaatggcagggcagcatagattgcttctgctgctgaggctggggtctgtgggtagcaaagcgtatggaataagttaaaaatgaagagggaacctggaaaatgactagaaatctctccctgaaactgcaggggctttttattactgttttcattattattactggtccatatagtatgtcaagcttccaagatgtccagggtcagggagagaaagtgaaaactgggttttctgcccatcctgtgaccatacatttctgtcaaatgggcatgctaatctcagaagggagctattgttctcactttctggggaagtacattcatgttcctccttccatcagaggacagtcactcttaagtctagaggctgattccccccaaacccatgaaaccatgttttcccaagggacttccaggaaagcagcactctggaactttgtaattctgtacattcctgaggttctgggctttctccaaaatgcatgtcccagtttggtataataattcgtcatggctttggcatgatgaatctcaatttatgtccatttatattttaatcatgaaccagctattaagacaaagaggtttttcagttgattcttaccaatgtgaaatgccatatcttatgttacctagttcaagtctgaaggggagcctcccagttctggtgttgggtggataagccccccatttgttagggtctttttatcagtttctgttgtattcttgcagcttctatcttcccagatgctggaatcctcatatagagcagccccctttgactcaattacctgtatagcttttcttaccttctcctggactctctttgtatctactatacattctttattttccatttgtacattggtgacatgtctacaggtatgtgttgatttttttttttttttttgagacagagtctcactctgtcacccaggctggagtacagtggcgcaatcttggcttactgtaacctctgcctcccgggttcaagtgattctcccacctcagcctcctgagtagctgggactacaggtttgtgccaccacaccgggataatttttgtattttagcggagacaggattttgccatgttgggcaggctggtctcgaactcctgacctcaggtgatccacctaccttgacctcccaaagtgctgggattacaggcgtgagtcaccatgcctggccaagtatgtgttgatttttaattttcatactgcgccatgtttcatggatggtttgaggtagcttataagaataaaaactataaaacaacaacaaaaataggatcttaccagtatattggaaaatatttaaaaatgggatgatagcataagaaatgctgtttgatgatagaaagaccaaaacagtatgtgctgatcctcttaggttggtgcagattaggattattttgagcttgtacataccaaggacttgaatcaagaccaatagctttatgtgagtgaggtaaaattagctctggaactgggtaggtagataaaaacaatttgtttcttggttgattgttctttttttttttttttttccaaagagacggagtctcgctgtgtcatccaggctggagtgcagtggcgtgatcttggctcactgcaagctctgactcccaggttgacgccattctcctgcctcagtctcccgagtagctgggactacaggtgcccgccaccacgcctggctaatttttgtatttttagtggagatggggtttcaccggattgctttttctttatcttagacattagttgatattgaaatgtttgtatgtgttcctcacaccacccgcacgtaggatctcaatttgccagctctaggaaatgggagagacctatctaataggtatctagtatcttcaagaaggaggaggagctatggaggagaaggtgatagggagagaacaggggtgagtagaaagaaagaggaaggagaggagaaaggagtcctctaattcgcctagataatggtaatattaatgagatactctagttaatgaggcaattgtctggcagagggcgttgttcagtatttccagcccatttctgtgggcttgaggcaccattatgagaagctgaatcagatgtttagaaggaggaaaaattgggcttccaaaaggctgaggccagaaaacagtcaatccacaattgtctgtcatctgtttgatgcagatcagatggggacatggccctgccttggtttctccattgggactgagttctggcttcatatttcaactctcctgacacctgagagggttgtcatgaaatgagaggaaacttctccccttaatgtcattctcccatgccaacttggttttttgcttcttagtcactgtttctgttttccccagtacggtgaattcccccaggatggggaccagatatccagtattagattcagtcctcctccatgtggagtcaacatctttttgtcagactgggagctccctaaagacaggaatcaatgtattttatatcattttaggagcttctcaaagaaagcaattattcctctcctcctttctcctctaaattctatggttcccattggggatcatgcattactttattccacaaacatttataaagacctggtatgtgccaggtactgttctaggcactggagatacagatagactgagttcctgtccgaggagcttgcattttggggtggaagtggtaagagagacagataataagtagataaataaatatgtgtcaagcaggaggtcatgctgtgacatgtaggatgatcagagatggactttcagagaaggtgacatctcatgctaagtgatatacaattatttgggcaggtagatgagagttccaggcagagggaacagcaaatgcatcttctgtcatctctagtatctccaagggagtgtgagagaccaggagcagcatcccaggaggcccagggtcacctgatcaccttaagtctcagaatcagatgctcagacatctgctgcggcagattgtctcctgcttgggctgtgtccagtctcggtgccagcagcccttttaaacccatcggcaccttcaggtgttttccttcccctgcctgtctgtgaggtcttttaagactttggaactgggcaatctaggtacaaatcttgtccctgccacatgatggtcgtgtgacattagggaagtcacttaacttctttgtgtctctgtatatccttatctgtaaaatggagatgataattgtctctagttctctctagagattaaatgagttcatatatgaaaatgcttagaataaacctgcatataataaatgctatacaaatgttagccactattattgttgctgttgctgttaacttgttttagcaaatgaagcatctctcttacaatgcaaagccggcctctttcccagttcatcctcctacttacctacaaaatgagggatggagatgaacatgaacatgaactctaaggatttttttgttaggcttgcctttctgggttctactctaagccacattcagctcaccccaactctaaggctgcaaagctgattcggcatttagtagaccattttcctgctcatggtccatggagattagccttttctctttagctctaagttccttcagggcagggatgaaggttccacctctgttatgtctcctggatcatctaggatgatccgaaggattcccagatctgggcattttattctgtgcttattagggatttcagaaaaatgtgctctcctcatgtttggcatgcaatcttttcaacagtacaactcttcattctccatgctatcctctggtggaggcagcatagggcgctggctaacagacctcagacttgggatccacgtggtttgggattgaattctactgggtcagtgactttggggatattaatgatccctccttattaagaaggttaacaaggcaaggcacagtggctcatacctataatcctagtactttgggaggccaaggcagtcagattgagcccaggagtttgagaccaccctgggtaatatgactaaactttatttctaccaaaaaaaaaaaaaaaaattagccaggtatggcggctcacacctgcggtcccagctacttgggagactaaggtgggaggatcacctgagcctgggaggtcgaggctgcagtgagctgtgattgtgccactgcactccagcctgggcaacacagtgagaccgtgtctcagaacacaaaaacaaaaacaaaacaagtcaatatatgtaaaacacagaaaggtgctgatgagtggtctacaaatggaaaccattgatactgttattgttgttagtgttcttccagtgtgctttatacataaaaggttctaaactgtaggttaggatagtccttctctgaatatatataatctgtgaaggaattctttcactcagaggtggatgtgaggcagcattctgcagcatctcagaaactggtgctcattaaggcacaggatcctggctgaggccagtggcaaagcttgcttaaagatactttgtcatctttccgtgtatctcaaactctgtgccatgttaggggatgcggcaaatatttgcagaatgaattaataactggttgaaggatggatgggtgaaagatgagcctcttctgtcttattattactattaccaaagaggcaacagtgctttagcttgttccttcccctccctgatcttttctctcccactccaccttttgaaacttttgttaatcttgctttcttctaccttgtctcatttccgccttgctttcctctctcctctgccacctctcccatcgtctctaggcccaaccatgactctctgtgtctactatttgtcgcttctgccatcggtatcaagtactaagtatccctcaaatccagagtattcacagtgcagtgacccagatgaaagggggttgggattttgctttcttcccttggtaactatttctcaggatgacccagaattcatttgcttaggtaacaagacaacgaggtccccctccttcactttgacaccatctgtgtcagtgttttgataacagtccttgccaagtgtatcatggctgaaattgatgctaccaggacacaggaaactcacaccttttctcaggctgcctttctttcctctacacttactgctgtttaaatgtcaccactcttgaacaaacagtggagtaatgtgtcagggacagctaatgctatattttggtatgttcttatcaaatcaaaatgcctctggcaagctatttgcctttgataaaaagaatcctggtcttcctggcagaactcaatagtaattgaaccaggccacacccttaggacttaggcccctgtgggtgtcctgaatccagccccttggccacacagtagggtttgggtcaatgcccttagcattaacaaggctcagtagtctgaattcttttcagatattgactgctccccacgtctctgagaaggactcgcttttggggcctcagtttcaccatttggacagtgaacttccatgctttgccagccgattccttaaataatctcaccaaccatctgcagataattgctttgtgggtagcttatgaacagcagctgggagctgcccagtccccatcatttttgtctcaaaagcagggtttgggggccatactgtcagtagagaaatgtgtgctataatcattattacttatgacatttctacttaactaagaaggcatttccaggaaatatcttttaaatcagtaactttaagaagctgacgctcaaaggggatttagaatctggattatttttctgattcaaattatcttttcttttggcctttgaagaagcaaatagatatttatttctcttgttccctcctctgcaaatgcttaattgattttattcctgtcagctgactgcaatagaaatcgctgtttccacttcttcctgttaacaccttttctgcaggggtggagggctagggggaagctgggacaggtgaatgtcttcttgcgttcggctgtgttgtgcatggagaagatttggagaattttcattcttccaaaattatccacaacactttgaaatgaggtgacctcctgttcggcaaaatgttgatatgatagtatttatgaggacagtttgctatgtttacagaatgtatatttggaagttgcatgtactaattggattttgaatatttttgtttctcattgtatcacacctgaaatgatgaaaggtcatttaataaaaaaaattgaaccattgatgcctgagtggctgcccagagtaaaattgcctaccatctgtcaaggcaggaaaccagagtacagtgaaggtagggggagaggctcccaaaaggtggggtctgtcacctagaggaggagggcgtgatggctggaaggggtagtctgggtttctggtgactgtgtcccacatcaggactgcatgcagctggagggacagagcttcaagcaagccatcccaagatgactgtctcgacctcctcagtttctgtgaagaggacatcactgtctactcacagagcataaacccagaatgttttgtctgtcctactcctgtagacaattcctcccctcaccagtggtgaaagagccaatacaaagtcctgactatatgttctgacttttcctagggggcttaaggaaaggcaggggagtaataagcctctgctttgagaagccacctccttttcccctttgttcttggatagctatggaatgcaattatgtgcatttaggacctttcattgggctttgacattcaaaccacacacatgcccttgcaggttgaagagagaggggatatcctgactaacacattcccggactgcctcagagatggagcttcatgagaaaagcctgctctaggacttgtgtggcctcgagagcattgaggttgttcatgatggagctggcttttccagttgcctctgaacctaggatctgctttctctctccttcccacatcatagattgaatactactctaatgtaatgactttggctttttgtttgtttgtttttattcacaattgcagatagcgcataggcattctgcatatatcaatcttagggttctgtttgttttttcatgaaaacattgctttgttcagtgccctgtggtataacctgtggctgcaggaattatagaactgctggtaggattctttcagatagcaaggagaatattgcaatgaaatatagagaagaaagagtccgctcctgctggggtctttcatccagccaattgtttcccctctctccactgcctttctcctctctacatctgggcttctgtttctttttgtgtttctccacttctgtacccacactatcctttttccatcttgcaatacattttgttctttttgttgctccatgtaaggggcctcatggattgctgaccagcctattgcaggggttgcatttagctcaggctttcctctgagccatttagctgtgggcagaattgtggagttgcatgttaaaaaccacaagagagctgtggttatgacaggctctctgcatggaataagaaaagaacaatcttgggcaaaaggctctcagcattcttcctgatagcactgccaaccaaaaaccaccctaagcagattgtgctgaaggttggccacttctcagtccagatacctggctgaatgtttccctgaaattgagcctggggagcagattttgacttttcaggctacttgctcataaagccaaccatgtggatacaaaattgctcacataggaaatgccaagtggatgttcactgttgcagccattatgagcgctgacattgttgaggggacatcaggatcctgtatgcctgcctagccactgtggcttgtgcaagtagaaataaggtcattttttaattcatagcagagttgccagatgatcttaataagtatgttgtctcattatttaaataccatctcaaaaaatgcatatatgtgcgcaaatatttatacacatgcatgcatgcatacatgcacacacacattcatagtagaagcactcttaaccaacttgcatttcagcaacttggcgtattcacccacgccagccatcttcctgcgaaatatactggctgcagcacatcaccctacagatgcatggcagggcacttctgttcccaccaggtgaactgtatgtttaccaagtcagctgagcctgttcccaaacctacttatgttagttgtgtttatattgtaataatgtggtttaattaaatgttataaaaccaatgaaatgaaagagtgcagagtttttttttttttcatgaaaactaaggtgaatgtttggcaagactcagtgtgttttagttttttgaatacactcaaccaagtgtagataaggcagttgtaaaagcttgggaggaaaaaaaaaatcataaaattctagaagaagtctgcactcagattgccttaggagacttttaaagttctagttcctctttaaagaaaacaaaacaggaaattttagagctacatagtaagaatggtttgtacaaagtagtccatgctaagctttagtcaacagatccatatgcaaaagaaaagacctaagcctatatggaaagagcagcaaattaatttgattcacatgatttaaatcaaaatgtttacatatgaatgtagcattttaaccaacttaaaaaaaaacaacaacaacaaactagccaactactggttcagatcacagtgtataaagtgcttctgctcactaatacttgcccataaaatcaaagtctggtagttttgtttagaggtgaaaggagagaattggcaaagaaattaattctccaataacttgcctggattccatttttcttttgccatggaattcaggttctagatggtaacaggaaaagcaggcatttccaggtcgggaaaagcgggttctagatggcaacaggagaagcagaaggtgtgtgtgtggaggaaaatgagggttttcagaccctgggacagctcccaagtccgccgcagtgttcctgctggatgcaagccatgggggcagcacagatgggaaaccctgagttggtgtggatgggaacaatgaagagcaggaggctgaagttctgtcaatgcttttcaggtcaagagtgggaggtggctcaggaatgtggcccctgacgtcagcccgtgcaactcttgtcaacaaagagagctcccagttggagaaattaaaagcaaactttgactgggaatgtgtgggaagtggtagctcagtgagtgaggccagatgccacatcagctcaaagtaaagccatgcacttggctttactgatggagatgatggatgtttatgatccccagtgtgaaaaatccttgcaatgagatccatccctgaactcctcttctcccatctgtgaagatgcccaaagactctagactggccttggagcagtccctgggcatagcatgccctagagtacaaggcgagggacctttttggttgacacaattccccactgtctagcccagagctcatcagggaggcaatcattaaagacgtgaaagcgttgagcaggatgtattctatctaaggcaaattcatgtgctagaggacctcctggctgtgttccaaggagcgtctaccttattctaacaattgtgagggatactcagtggagtccaattggagacttatctatcctaagtaaaataaaccctctgttgcacatatgaaagtgataaataatttaaatacaattttaaaatattggtgcttctcagcatctcccactcctcatggttctctctttgacacctccagagtcccctagaaagggtgactttattctcaagcatcattccagtgtgcttcctaaccaataccagcagtgccagggccatccaattgacaagtgaaccctgggctgctggcccacccattattgtcactcatctgtgggctgatacccccttcactttgctcaagctcccagcttggccattggtgctcctccatcctgcagtcctaccccttagcctgccacagcccttgacttttcaggcccaccttcagccaggcctcactctcctacttctggccaggctgttgcccaaattgccatctccagtgggtagaagactatttatagctcccactgcaaattggttcggagactgaacgctggtctcctgaaatagacctttagtgtggacagagctcatggcaaaccttcttgggtgtagggtactcagctctgtccccctctccctagaggatgtgcacatggctaatgctacaggagtgggggtgggttctaagaaatacccagaaccactgttcactcctaccctcaggtccttttgctaaaccaggcttgtttgtggatcttccttccctaggagtgggcctcttctcagtgtggggttccacagttctgctctttaccagtggggttctgtttctcacctttccccagcacccacacttgtatatacctacacacacaccccttccactgccatgccttccaatggtctgggaagtgttttagtgggaaatagtctaaagtagaagttcatagcaaggggtcttcaaccagactactgggattcaattcctagctcttctactctctggctttgctaccctgggtaaattacttaacctctctgatttcagtttcttcatatgtaaaatggggtaataaccatatttactttataaaggctattataaagaataaatgaggttttcttttgtattttgaggagtacctggcatgtagtaagcccttaataaatattaactattaatataatatctgaacaccagtcactgtggctgctcaaagtttttttttttttttggacacttcttgactactgtgaatcagtagatacaaaagatactgggtgcaggacgagttcccagcttcatacccaatctccacttagactcatccagaatattttcttacacctctagccgtaaatattcaaaaattgctacatatgttgctagcccatcaagttattagtaaggaaccccatttgggtaggctactagtgtggaacctcacctctgttactctcagttactctttgtgtttaaaatgtcttagaattctttgtatctttaaattttaattagggattgataacaggttctgataacttgtaaatggagactgatcatttgttagcctgtgttttgatacgtagactttaaaaaaaagaaaaacttcttcggtcagaagctgttgttctgtgaaactagaccagactgtgttttggcttgtgtgagaagggaaagcatattgtttgtaggtgaacagtttgcacgactattgtgataatctatcctgtctccctgccttctgtgtctacccagcttagcctatctttttttttatgagacgaagtttcactcttgttacccaggctggagtgcaaaggtgcgatctcagctcactgcaacctctgcctcctgggtttaagcgattctcctgcctcggccttccaagtagctgggattacaggtgcccaccaccatgcccagctaatgttttgtatttttttagtagagacggggtttcaccatgttggccaggcttgtcttaaactcttgacctcaggtgatccactcgcctcggcctcccaaagtgctggaattacaggtgtgagccaccatgcctggccccacctagcctattgtatacaatgcaagtggagtaatcttccaagggcatgattttgattatgtattttttcattccggaaagcagcgagggccaccccgttgcctaccaaaaatgcacatttatggtccatggcaacctgttgcaccttaatgggtgagagagctgctctttccactgcccccttcaccatcttggtgcttccgccgaattggctgactcctgcttgtcacaaatgctttttgccttcttctgtctctgcctttttagttcccacccacccactttcctattgtatccttgtctggaacagcataccacattcctgtgcattgttcaggactcaatgtaaagccacttctcccaggaatctttccctaattcctctcagccaaacagaatcacccctgaggtgccatagcccttcatcccccatcacgtgggtatcatataccatttctagtgtgaggtataaggatattttcaatggacatttttatgtttgaatcttgtatatacctgcaattatcactttaggaaatagtcttagaaatatttaagatctttgatgcatattgcaaaattgccttttaggcaatattattccatttattctctactgtctgtgtattggggcccattttcccatattctctataaccctgggtattattttcttgccaccttttgctattttgatggtttttttttttaaagaaaaacctttgttttaattcatattgcattgctctaatttctagtgagactgaacatttcaaaaatgtgcttattagccatgcacattctctctgaattgtccgttgacagggcacttgacactttatatcatagtagttttgtgaacttgtcagctaccaaggatctatacgacaaacagctatactgtcagcccagctactgtgcttagaacatgataggtatgtactaaacatttgttgaaaggttgagtgaatgaatatatatggctgatgatggttaatgttccttaagcatttaaaaatgtgtagactctaatttacctccagtacaacaattcaagatgcaaatcttgaatgcaccattcagtgtgatcatgacagtgcctttcacttagtaagtcttccacttgtgaggttggttaagaggagtgtgaggttagatttgcaaacataaaaacctctggggtagggaggtcttttggtcactctctatgatcctggaacatcacgtgctctttatttatacttctggacttcaccaaaatagaggtggtgattttggagcccaagaagcaggaaggcagggtgagagcagacctgtgcttgagagatgtctgcttttcagaggagatggtgtagtgacaacttcagggactgatgcctggctattaggatcgagtcttcttagatgtcagctcatttccttgtagaaaatgaaatctaatgaaagctggtttatctggtattccatcaagcagaacattttttattacatcatattcatacgaatgaccctaaggcacagcaagatgatgttcagggtcacattggagttaaaggtcttataaattatattgtcattcttttgaaaattggtgattgtggcagatgtggtaattttccattcaccagaatgcctgagttaccaaaagcaaagatttctgcagactgggaaagttttgtgggagcgtgtatgtttacatgtgtaggtgagcgcatgagtacgagtatcggagtacgagtatcggaggaacaatgagctggagtccactagagagtgaaacttacagagtcttgaccattcatcattctgattctcagatttcaccagctgacaagcaccttcttttttggcggggggggtcagagtttcgctctgttgaccaggttggagtgcagtggcactatcttggctcactgcaagctccgcctcccaggttcacgccattctcccgcctcagcctcctgagtagctgggactacaggcatccaccaccacgcccggcttttttttttttttttttttttttttttgtatttttagtagagacagggtttcaccgtgttagccaggatggtctcaatctcctgacctcgtgatccgcccgcctcagcctcccaaagtgctgggattacaagcgtgagccactgagcccggccaacaagcaccttctaagggtgacttcactttggaattgtttggttgaagcaagggaagtaaggaaaccaaaacctcttcaacgctatgctaagtgttacttaatctcatttcataaaggaaatatgaggctggattatatttatttcgtgtgtgtgtgtgtgtgtaaattttcttaagaaagcagtaagtggttttttccttgtatgcaggtagcacctgccaacctgacctgttgacagataattgcttgacagcctggcctttgatgttaagcgtcacttaggcagaaagaaagtttccctgcacctccctaccagtcctgggtggtcttgtctgctttccttccccagaaccttgcccaggaaacccatgaattcaggcccccgggtgcaggtagggtcagcaaacgccagaccactccccaatgtgtggagagcgaggaggggcctgcaaactctgcttaaaacaaacaagtgctaaattaaaaagaatgttaaatacagatcagctgcctggctcctgacagcagatttaattcttccctcctctcacctgatggagcttcgcctgcagggtttgcatcaattactcgacgacatgtggaaaatgattgatgagctgcctgcggcactgaagtacactttgtcaaccgctcatcatttatacatcttatctctgccagaacaaaagataggacaacctcacactgaagttggggatgggaaggggggagatgaggatgggggtgagggaggcaagtcaggcaaagttgttgggtgcccacagggacgagcttgggtggtgaggcccctgctgttgcctcagaactgtctggtcagtcagctctgccacaggccctggctttgccaaagctctttgactgtcctcacctcccccacccccaacaaagtccaggaacagagaactgcatgctgttttaattacagcataatctcagagagctttcgaggcactgcagccactctgcagctgaccctttgctttaatcaaccactcctaaggcagggtttgtaaccatccctgacaaagatgaatcacggcccgtggatccagtttctgagagaatttcggggggagctgcccaggcagcagcggctgttggggccagcttttgggaaattggggcatctgatgatggtgagacttggcggtgatattcatggttttatttcaagccatgttcccaaggccggaatgagacccaaatgtttttgttcagattgagatggaaggttggtggtgatgctgactccttgtttgttccccagctgtggccttaggactaagacccctcctaacatgggaacaaaaaatatcacctcgcatatggctgtcttctctttcctggggacactattatagccacaaatccaggtgatgacctaacaatcatttctaggcaataactgctgaaaatagctattttattatgagctgatctctattaattcactctctattaaaggcatcccatttattgatttttttttctttgaaagaaagggtactgacaaatataaagtcaagtgacctagttatataatttgagtgattgacccaacagattccttagtaattggtcagggggtggaaaggaattaagttagaaaacttcaaccttataatataataggatttccctccaataaaatttgatacattacttacaaattgctaaataataaataagaatgaaaaatgaacatacctactgaatgaattataaaagcaagtaatacaactatgaggcaaaatcatgccagaaaagaaatagctccacataagagaattatgaaatggaaaaaggactcaatacccaggagaatatttctgcggcctttgaaaatttaaaaacagtattttgaactcttccaccagtttagttggtattgttagaggaaaggttttacctatgctcaagaatttgtagatgagataacagtgacaggtaaataatcatcatgatatcaaatgtttttataaaaatttcatggagcatgaattatactatacagaaggaccctcttggaccagaagagaagggcagccactgaggatctcataatgcccacaaatgtgctagcgttggcagatcatccatagtgcgtctctgttctgaatgaaagaaagcccttgcaggcttgatgaactgcaaagggacagcaccaaatggaggcatgtggtccctttaaggtggaccttaagatttgatttcagatttaagtggtagtcctatgcaccacaatgaatggagttttacattttttgtgcttttgataacccttcaaggcttctatcttgggaaatggtcacctatttggtattcattttgaaaggtttgaaagctatttgtattattttcctaaaactgctgtaacaaagcacaaccaactaggtggtttaaacagcagaaatgtattgtcttacatttctggaggccagaagtctaaaatcaatgtgtctgcaagggttggttccttctgagcgctgtgagggagaatctattccattcctgtctcctagctcctgacagcctcaggtgctccttgacttgtagatggcatttttactctgtcttcaccttgtcttccctctatggatgtctgtccttgtgttcaaattttctttcttttttttttttttaaggacatcagtctcattggatttgggcccatcctaatgaccttatgttaaattgatcatctgcaaaggccctatttccaaataaggttacactcacacttacctggggttaggacttcaacatctttttgggagaacacaattcaacccataattgtattacccaagaactttaattcgagagattctaccttcagtgctttatcttgtagtttaaggcatagattgttatcttgaagcaggagtcgtgtcatgtctgatctaagagtgggcatatagtaactacttgataaatatttgttaaattaatgaatggatgagactttaatcttgaacttccttggaaaaggcatttttatatgacatttgtaccaggaaaatttactaatttacaatttatgaagtcaatgaactccagagggacacaaaagttttagcaaaaaaggctttctttcaaaaataatatgaagctcagagtgtggccatttatagggaatcttctttttgtgaatggcactttagagagaagaattccctagataattctgtttttgcagaagtcagtgccttgtgctggatttattttcttgccaatacattgtcacttggggaaaaaattccccatggaaactttatattataagtttgttaaaactggctcaatattgtttatattatctggttcacatgctgatatataagggagattcaatattatgagtaaactattacctaatatgtgcaaatgattgagtcttgagttagtaaggaggaaggttttgtgtcttccagaaacatatttacatacaagtgaacttttaaacatattaaaaaaaaagcaaaaatgactatatttgataaaaacttgtccaaaaaatgtagatatagcaagtttagagattaagatgtttatttgtataaaatagatgagcactttttgttcttaaactttctatatttatattttacataagtttttaaaatccgatacagtcaatatttgtttattaaaattatatgatggaccatataatataccaggctgaggaggaccaagcgtatcaataccccaaggaagcacgtccatgtgggtaatgttaaggatacctatatgtcaggccctaaccaaaggaggtttgtggaacttggagagatccaggaggtaacaccaaaaagctgcatttagcaatgcctgcctagccctcctgtacagctcatgttattttgttgccttaggccaccttacaccaaaccattcctatctccatgcttttgtttatgctgttgcctccttttagaagggccacgctccaccgctctgctgtgttgatactaccgacccttcctttagttcctgttcaattcccaagccttctgccaagccttcttggacattcccatcccatgctgactattccttaagctaaaacccttagagttaatatgatacacttggctacctcattgtttcatatcagtcattcctgtctctagctataatcggctcagccaaggaagatatatttatatggacaatgtctttgtgccttggctgtaaacagtgttgaataattaatctcacttgatgaggtcttacttaatgatagcctccaattattcaccaagacgaggggcaacgatgcttgtccattgtctgtgcaggctagactggaggaaagggccttggggaggaacttaaggtagatggaatttgctgatggaaatgttatttacttgatcaaattttccactggcattggtacatacttccctaaagagggttaaaaataagaaaggccctcctgggagtcaggagaagtgatgagatgtgctgtagctaggcccttcctttgtgaaatggagtttatgctatagccagatgtcacaatgctcaacaaatgactgaagtccatcgtaaacaacaccaaaaacaacgaaatgcatttattttaaaactactattttgaaaaaacacagtccctatggcaaaaaaaaaaaaaacaaacaaaaaaccctaaactttgacttggggtgacaatgtgtcggaatcctggcaaggctgaatgtccctttaagagacttgatcagagagggatccatcaacatcccaggggttggctggggggactgtgattctaaaattaggaacagaaggaagaactgaggagcggtgagaactaaattaggagaatgttttaggaagattataatttcagggaggatagctcataggagttgtgtattgcccttttgcaactgtagacattttttaccttataattccctgtttaaacctggacaactttaattggggattaaaaaattatggctgaaacacagagccatgttctaatgatgaagggctgcaatttacagaccaattaggatggcatttgttttcattctgcagcaactttttccccccagtgtacccctcaataacagcaaaacagattcctgggtccaaaagtggttttccggagctgacagctgccatatgcctttggctgacaggtgggggacaggttctggacagcttccagagaaccactccttgaattttgcccattttgtagagccactctctctgcaaaacaatgccatttaacttcaagctctgacaccttgcctatttctacttcactataaataaacctactccccccatttgcttgcctcccccaggtcaggcattcctcaattatagtcttaaacctggccaagcgagaacaaatggtgaccttaagttatatcttaaagtcctgcctcatattgggacgcagagtaagtttttttggcattctctttgacaggctgcttgtagatagaacagttttccataaggaattgaaatcatacatcaaatgtattgttttatatgtaagccactggagaccaatgaaagcagttggtagagcccaaataccattacaaatagatttattgtagtgtgttttctcccacctttttctagaagttattactttaatcttaagaatttatgtaagtatgcttgtggcttttatatggtttatgcattcactttggagacttttagctatttagtggcgaggtgtttaaaacaagtgttatcaaggaaataattttggctttacatcattttttttatatttgcctctgaatgctacatatagaatagccaatcggcaatataaaagagttactgtggatgtcatggaaacttatctttccagtgccctttagtttggtgtgttcatctgcacctccaaaaagcaagcggagataaacatgctgtattcctttgctgccaaattagaaaaagctctgtgccttccttcctgaaccgtttcaaagacagacagagaacattagacttcacagcaattaaactcactgtagtgtacatttactaaaaggactggaaatctttttttcagccagccccacagtaacagagctgttagaaaatttaaaaagaaaaatcctgaatgatgctgttagtagataaattaagtgatcttgcaagacccttctcatttattatattaatacttcaactacatcatatttagttaaaaattttttgcatattatcctacaatttaacctgtttagtaatttttttttcacaaaccccttttaatttaccaccttcctctacacacgcacagacgcacatgcttacttactctggtttcaaatattatgcataaactgatgttttgatttggtagccataatttctaagtctgttgatagaaacttgtcaatcatttccaaggcaatatgttgccatctaactgttttgatatatgtgaagctcttgtggtttgtctagttcttataaaaatactgcgtatcccctttgatccttcgtgtactttcaaaacttgatactggtggggaacttgactcttcagtttcttttgaacttgttttagaattatgacagtgtttttctagtacagaaaagtagacacacctaggggacccaaagagacctgactgttatgtcaaactaagagtgcacgtgttattcttctgacagttattgagattaaaaagcaggttagcagttttcttagaccatatcaggccctgaagaggagacagtggcttttaaatctctctgtggagcatgtttaggagggacagtgcctctctggggatggaggtgccttccagttcaaatactgtttggaaagtggggtgactgaaatcaattttctgaccctgtttgtgtcatcttccagaacacaaaggactcttttcatagacttttaagtttaagctctgttccaatctgagccagtctccaccctttggaaaccagaatatgccaccccaaaatatgtctctctagcgtaaggattattttgagctgattatttggaggtctacagccataggagaagcgccgacaacagaataaaagttaccctgttaaaagggaaatttacatctctcaagggaatttccattcatgaaggtggcttctgtctgtaccaagaaaagaaggctgactgcatcaccagagactcctttcactggagaaggtgccagctgaaatctgcagaacaaaatctgaaatctgaaatctgtttttgtggaccatacttcacctgaatacctacccagtatatgtctccctccactcccacccaacatccttctttctctgtttcatttcaagatggtatttaagcctgaactcaagccacctttttaagatttgctcactttttttctgggtatctcccttgtataaatgagttatcactggagctcagaaaacagtaccccaaaggatggcactttggcagcatgggaactttgaaatgaagcaaatgaaaagatcttagaagcagcttcagaaccaaagactttctcaccttctgtttctctccccaagtacagggtggaactctctctctctctctgaagttctctcatttgaagcttctcgagaagaatgaacacaattgccttcaatctcctccctgaaatttcattagccagaaaagattaaactcatattgcaggaaggaagactaaggaatgccaccacacctagacagactttgtcacaagctgtttgctgttctttggtcccattcagtttccaaaaagaattatttagaaactattgcctatttacaaattattctttgagtccaaccaactctcctaaaaatcatactcttttcaaaattgcctacattcccccatctccctctcccctaagaagagggcagtatttaagcttgaaccatctggtccttctttgagtcttgtattttgtatggctcccatgcacaccagcacattattaaatgtgtataccttttctgctaatctattatcagtttctttcagcaggctcaaactttcagaagaggagggaaaaattctctttgctcttatatcacacatgttaataagcttctatttgttcttctctgttaatctgtcttttgttatgggggtccattccaactaagaacatgaagggtggagagaaaatgatttttcctctcctataaccctttttggcagcaatggattactaaaagattattttcaaagcacagttttaattaatactttgaaatacacctggtaatacatactagtagctggcgcagtgcccttcagttgagaacctcttttaatgtctagttaaagatcatgtgtaattaacatactgattgttatagaacaaatgaatttagatatgtatgtcaagtttgtacacctaagtaggttaagtactcccacctgatgtgtctcatgctattaatttgctgagtaaacactatttttatagttgaaagatcagttccattccagccattccaaattagttttgttcaaactaatgagaccttattaaattcgaaaggtgatctagattggggattatagtcttgtcacaaatctctctgaaattggacatatatccagctttcaagccccttggtccatcagccccaaagcgtaattccttctaaggtttgcaaaccatagagttttacctgtacctttggtttttgctttttatcatcaacttgacttcaacataactgtcctcctagttattttctgtctcgttttaattgttttgtgcagaactttagtttctttgtcttttctaacttccactggatatcctgtttgaatcgtggatgcatttacatgttgcccccttacctagattctactcttgactcataatactgccccacttgggctagttttgggagaagcccttatctcaacttttcaccttgtctctatccatagcttctctgtggtcctaggctgcaagaaattttctacctcaaggtcaatactggaagacatctttttctgctttaagatttggctatcccctaatgtagatgatttttttctttcaatggatttcaggtgcatggaattgaattaatcataattcttggtttatgacacactatcaattggtttatgtgtaacatttataattatatgtgtgcatttacatagtcttaaaaatgcaatgaatgaaccaacccaagaattagaatatagataataacttatgtttttctgtgtggtcctcttcagtgtaatcattatcttgaattttgtgtgtaatatgccatttcatttttaaaatatttaactacaaatacatttatgtacctaaataatatattgcttagtttggggctgtttaaaactttggtaaaaacaaagcttgtcacgcttgatttttttttctgggatttacttttttcactcaacattgtgttactaaacttcatctgtgttgatgctatagcagctgtttctgcattttcaatgctgtataatattccatcatattcaagtgcaacagtttattctccagaagatggtcattatgttattatctttattattattattattattattatactttaagttttagggtacatgtgcacaatgtgcaggtttgttacatatgtatacatgtgccatgttggtgtgctgcacccattaactcgtcatttagcattaggtatatctcctaatgctatccttcccccctccccctacccaacaacagtccccagtgtgtgatgttccccttcctgtgtccatgtgttctcattgttcaattcccacctatgagtgagaacatgcggtgtttggttttttgtccttgcgatagtttactgagaatgatggtttccagtttcatccatgtccctacaaaggacatgaacgcatcattttttatggctgcatagtattccatggtgtatatgtgccacattttcttaatccagtctatcgttattggacatttaggttggttccaagtctttgctattgtgaatagtgccactgtaaacatacgtgtgcatgtgtctttatagcagcatgatttattatcctttgggtatatacctagtaataggatggctgggtcaaatggcatttctagttctagatccctgagaaatcgccacactgacttccacaagggttgaactagtttacagtcccaccaacagtgtaaaagtgttcctatttctccacattctctccagcacctgttgtttcctgactttttaatgattgccattctaactggtgtgagatgatatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttgttttgctgtgcagaagctgttgagtttaattagatcccatttgtcaattttggcttttgttgccattgcttttggggttttaaacatgaagtccttgcccatgcctatgtcctgaatggtattgcctaggttttcttctagagtttttatggttttaggtctaacatttaagtctttaatccatcttgaattaatttttgtataagttgtaaggaagggatccagtttcagcttctacatatggctagccagttttcccagcaccatttattaaatagggaatcctttccccattgcttgtttttgtcaggtttgttaaagatcagatagttgtagacatgcggcattatttctgagggctgtgttctgttctattggtctatatctctgttttggtaccagtaccatgctgttttggttactgtagccttgtagtatagtttgaagttaggtagtgtgatgcctccagctttgttcttttggcttaggattgacttggcgatgcgggctcttttttggttccatatgaactttaaagtagttttttccaattctgtgaagaaagccattggtagcttgatggagatggcattgaatctataaattaccttgggcagtatggccattttcatgatattgatttttcctatccatgagcttggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataagaatgcttgtgatttttgtacattgattttgtatcctgagactttgctgaagttgtttatcagcttgaggagattttgggctgagacagtggggttttctagatacacaatcatgtcatctgcaaagagggacaatttgacttcctcttttcctaattgaataccctttatttccttctcctgcctgattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgagatacgtcccatcaatacctaatttattgagagtttttagcatgaagtgttgttgaattttgtcaaaggcctcttctgcatctattgagataatcctgtggtttttgtctttggttctgtttatatgctggattacatttattgatttgcatatgttgaaccagccttgcatccagggatgaagcccagttgatcatggaggataagctttttgatgtgctgctggattcggtttgccagtattttattgagaatttttgcatcaatgttcgtcaaggatattggtctaaaattctcttttttggttgtctctgccagactttggtatcaggatgaggctggcctcataaaatgagttagggaggattccctctttttctattgattggaatagtttcagaaggaatggtaccagctcctcttttcacctctggtagaatttggctgtgaatccatctggtcctggactttttttggttggtaagctattgattattgcctcaatttcagagcctgtttttggtctattaagagattcaacttctttctggtttagtcttgggagggtgtatgtgtcaaggaatttatctatttcttctagattttctagtttatttgcgtagaggtgtttatagtattctctgatagtagtttgtatttctgtgggatcggtggtgatatcccctttgtcattttttattgcgtctatttgattcttctctcttttcttctttagtagtcttgctaacagtctatcagttttgttgatcttttcgaaaaaccagctcctggattcattaattttttgaaggtatttttgtgtctctatttccttcagttctgctctgatcttagttatttcttgccttctgctagcttttgaatgtgtttggtcttgcttttctagttcttttaattgtgatgttagggtgtcacttttagatctttcctggtttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattccgttgatttggggtggagagttctgtagatttctattaggtccacttggtgcagagctgagatcaattcctgggtatccttgttgactttctgtctcgttgatctgtctaatgttgacagtggggtgttaaagtctcccattattaatgtgtgggagtctaagtctctttgtaggtcactcaggacttgctatatgaatctgggtgctcctgtattgggtgcatatatatttaggatagttagctcttcttgttgaattgatccctttaccattatgtaatggccttctttgtctctttttatctttgttggtttaaagtctgttttatcagagactaggattgcaaccactgcctttttttgttttccatttgcttggtagatcttcctccatccctttattttgagcctatatgtctctgcacgtgagatgggtttcctgaatgcagcacaccgatgggtcttgactatccaatttgccagtctgtgtcttttaattggagcttttagcccatttacatttaaagttaatattgttatgtgtgaatttgatcctgtcattatgatgttagctggttattttgcttgttagttgatgcagtttcttcctagccttgatagtctttacaatttggcatgtttttgcagtggctggtaccggtcgttcctttccatgtttagtgcttccttcaggagctcatttagggcaggcctgctggtgacaaaatctctcagcatttgcttgtctgtaaagtattttatttctccttcacttatgaagcttagtttggcaggatatgaaattctgggttgaaaattcttttcttaagaatgttgaatattggtccccactctcttctggcttgcagagtttctgctgagagatccgctgttagtctgatgggcttccctttgtgggtaacccgacctttctctctggctgcccttaacgttttttccttcatttcaactttggtgaatctgacaattatgtgtcttggagttgctcctcttgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttctcgcttcatttcattcatttcatcttccatcactgataccctttcttccagttgatggcatcggctactgaggcttctgcattcgtcacgtagctctcgtgccttggttttcagctccatcaggtcctttaaggacttctctgcattggttattctagttatccattcgtctaattttttttcaaaacttttaacttctttgctattggttcgaatttcctcctgtagctcagagtagtttgatcgtctgaagccttcttctctcaactcgtcaaagtcattctccatccagctttgttccgttgctggtgaggagctgcgttccttcggaggaggagaggcactctgctttttagagtttccagtttttctggtctgtttttttcccatctttgtggttttatctacctttggtctttgatgatggtgacgtacagatgcactttttgtgtggatgtcctttctgtttgttagttttccttctaacagactggaccctcagctgcaggtctgttggagtttgctagaggtccactctagaccctgtttgcctgggtatcaccagtggtggctgcagaacagcggatattggtgaactgcaaatgctgctgcctggttgttcctctggaagttttgtctcagaggagtacccggccgtgtgaggtgtcagtctgcccctactggggggtgcctccccgttaggctactcggaagtcagggacccacttgaggaggcagtctgtctgttctcagatctcaagctgcgtgctgggagaaccactactctcttcaaagctgtcagagagggacatttaagtctgcagaggttactgctatctttttgtttgtctgtgccctgcccccagaggtggagcctacagaggcaggcaggcctccttgagctgtggtgagctccacccagttctagcttcccggctgctttgtttacctaatcaaacaactaactgggcaatggcgggaacccctcccccaacctcgctgccgccttgcagtttgatctcagactgctgtgctagcaatgagcgacacacggtgggcataggaccctccgagccatgtgtgggatataatctcctggtgtgccattttttaagcccattggaaaagcacagtattagggtgggagtgacccgattttctaggtgccatctgtcacccctttctttgactaggaaagggaattccctgaccccttgcacttcctgggtgaggcgatgccttcccctgctactgctcgtgcacagtgcgctgcacccactgtcctgcacctactctctggcactccccagtgagatgaacccggtacctcagttggaaatgcagaaatcacccatcttctgtgttgctcacgctcggagctgtagatcggaggtgttccttttcggccatcttggctcctccgttattatctttactgttgcttattttgaacaggcctacaagcatctcctggtgcacatgacctagagtttctcttggaatagagtcgctgagtctttagttatgcatacttttaactttactagaaaataccaatctgttttccaaacagttgttctagtttaacattcccaccagcaaaatagtagagtttctgtgtatatacattttctccagcacttcttattgtccaatttattatttttgaggacaattaagtgggtgtaaagtggtatcccctagaattttggtttgaatgttcatcttcccttaggtgatttttccagaactggaattctgtatctcctttgcactaacaaagcagtagattactgtaaagctataaaacacaaattaaataatatgatcatctgtaatgcagcagtcaaggagtgattaggatgtgctgtgaggacggaagagaagtcattcttacagtgcagtagaaaaagccttggtcttgaatcaggagagtcagtgcctggtcctagctctgtaagtgattggctgagtgactcacatgaaaacctcatttttcagtgtttccatttcctcatctgttatttaagggtgttgatcacagagagtatgctctggtctacatttttgtcatttagtaaatcataatcatcacattcttttgggtgtttctttaaagcatttggcctccattttctcaggtgatatttccaatacctaagtaatgtaggcagagaaaagatgaaataaaagcctacaaattttggcaggggtctccgtagtgtgactgtggggagaccaggaagctcctcaagcccataaatatctctgttctggcctcccttagagcctaaaactccacaattactgtttcactgctatagttcttgaatgcctttgggtctgttggagtcttccattaaaatgcaaatgtccctggagggggtggggagagcctttaagctcattatcacctaaatcttccacagggattaattgatcagatccttccccatcagacacctggttggaaacagagcctgtgggaatgggcacctggttgatgaggggaagccctgggagggagaagaaaggttataaagagagaggtggaccaaccagggctccctagggtttggccatttgctgcttcccacaggctcatctctagccagaagctcaaaatccagctggtcaaacacactgggctactgctgtctccttggggggaagtttcctcttagaactaactaaaggctgccaaccagcggcaaaccctcctgtgtctgcaaatggctgccaaaagcccctccgcgctacacacttctgtggcagatgcctctgagcagccttctttatgagtcagtgctaaagcctagcccaggttctaatgtggccactctgaggcgtggacaggccttgtcaaaggctgggcatgcgtgtgggtgcctcatctgctttgtttgacatccaaacaactcttttaaaatgtggctctagccccacctcacaaagggggcctgaagggtgttgtggaatgtgcttggacctgctctgttttctttcggtcacccacacaaaaatgtgccttcccctcccctgccaggaaactccctcagcaatgcatggttttgcctccgctgaccctggccccttaacatgtcagaatgttaataaaacactacggctgtcataacgcaaggttaaatgaagtcttcacaacctgtccattaagcggatgtttgtgtgtgtggctttctgcagcttctctctggatacagcctgtctcagtttgtgggcagtcgatcgagccttgggcctttgtctttgttcactgttgtgtttaaatcccccccattcattaatcatccctttgcctatttataccggtggcaaggatagcgaacacacttaacgtctgcttttgttttggtggcaccctttgtgaggaccaaggcagagctaattattaactgcgaaaagacgttaaaacttttagataagcgccaaatgctgcatccactgagacgcagttttgtttaaaccttcgagagcttgcggccaagcaactggggtggctttatttagctttgagtccaggggagtgatgccagtgctcagataattaatagaggctctccattaagacccagccgggcagcagaatccaagcgccctgtatgcacctctgaacacccagctgggtcatccagacctgagcaggcacaggcaggggtggcagcttcagacgtagggctcaagggggctcctccaacctatatgtttacatttcctgtgtacatttcctgtgaagatcttcgttgtcagcttttggtgacttttacaccctccagtaggatcctgattttcctttgctgttggacattttgtggagccaactattttaggtacagctatatcagcttattaaacagttatgcggcttgctactgttcttctgaaagaggtctccccgaccacgttttctaaagcagttgcctaagcccacagccatccctcagttacctctattccattacccagtttttttttcccctccaaggcatctgtcgctatttgaaataatcgtatttgtttgtatttcttgtctgtttgatactagaatgtaaacctcttgtatcctttgcacttagctcttgatcgtcgcctggcacatatcaggggccaaacagatatttattttatgtgtgggggaggaaaaaaatatatttccctctacccattctaggctcattggccagggccctgtaaattagattgccaaaagataggttaacaagagaaaagtattttttgttgttgttgtaaattttatttttgaattgcattttttcctgctgatacatgaaaaagcaattttttgttttcatattatacacaacatcctaacttaacttttgtttatttactagtttgcatttcttaagtagacagtcatattatctacaagcaaaagatttgtttcttcctttccaatccttatagtttttattgctttttcttatcttattacactatataggacctccagtgtaatgtaggataaagtagtaatggaattatatcccaaaagttttcttaaaaataaagaaagcccacattactagtttacccacataataaaatttcttagaaccacataataaaatttcttagaacataaaattcttcgtttttaagtatccaattcattggtttttagcatatccacaaggttgtgcaactgtcaccactattcaatcaaaaacatttccgtcattccaaagagacaccccttaaccatttatacttactcccaatctgcctcttccttcagcccctgataaccttaatcaactttctgtctctatagatttgcctattcttggcattttatacaaatgtagtcatacaacatgtagcctttcatgtctggcttctttcatttggcatagtgttttcaaggatgattcttattgtatcataaatcagaacttcctttcctttttatgggtaaataatattccattgtatagatataccatattttatctatccattaatcagttgatggacattttggttatttctacattttggctatgatgaataatgaataatgctgctattaatattttttgtatacgtttttgtgtgaatatgtttttcagtatcttgattatatacttaggagtggaatttctgggtcatatggtaactctatgtttaattttttggggaaccacccagctgttttccataggtagtgccattttacacatttccactagcaatacatgagagtttcaatttctctacatcttcaccactacttgttattttttcttacagtgatcctgtgggtgtgaaacagtatctcttttggctttcatttgtactactctaaagactaatgaagttgagcatcttttcatgtgctctttgattatttgtatatcttctttaaaaaactgtctattcacattttttggcttttttttttgagacagagtatcactctgtagtccaggctggtgtgcagtggcgtgatctcggctcactgcaacctccacctcctggattcaagcaattcttctgcctcagcctcccaagtagctgggattataggcatccgccaccacgtccagctaatttttgtatttttagtagagacggggtttcaccatgttggtcatgctggtctcgaactcctgacctcgtgatctgcccacctcggcctcccaaagtgctgggattacaggcatgagccaccacgcctggccttttttggctatttttaaattgagttatttgtctttatattgttgagttacaagagttctttatatattctggatactaaacctttatcagataaatggtttctaaatattttcacccattctataggttgtatttttggtttcttggtagtatttctgataaacaaaatttttaattttgatgaaattcaatgtatttattgttttctttgatggcttgtacttttggtgttacatctaagaaactattgactaatccaaggtcatgaagatacacacctgtgtgctcctctaagaattttgtatctttggcttattcatttaggtcttttattaagtttggattttgtatatggtgtgaggtagggtgggtccaaatgtagtcttttgcatgtggatatccagttctcccagtattatatgttgaagagactggagagtgggcattcttgtcaggttcttgattttaaaaggaatgtatgctgttagattttttaaatgtaatatttatcagataaaagtattctatataattatgataatctaagagtttaaatcacatactagcctcttcactggaatgtgagaaccaatgtcattcccttcattaggggtgcagtcctgggatataaccttggcaatagaaatttagtgcttcctgtacctagaacagtcacgaaacaagataaagagaaggtacctattgctagtcctgttcagcagagtgactattcctgagacttggctagctcatagatcttaacttttgtgcctgcttcaaatgttggcagtggccatatggactgttgtgtttagaagtcttaggttgctctgatatcacagcgattgattaatgatatctgaaacctgcatgaaaagagataggcaatatagatatgacacatttgccattcttgtattggtccctctttctctgtcagatctgtcgtacttgaccctttttacattaaattgctctgtggatagaaccccttttctttcttgatcattggatttggccatttttctcttgttcagcttaatgcttagttctgactccttctgatggatacatcctgtttaatacttatgtatcagagaacaaagtcacaagctttgctaaggtagacacatgtgtttgacagtcctggccccaggtattctgttttgttgtcagattacgtgtcagaagaatatatccccataaggagtgagaaaatgagataaaaaatacaatattcagaatgacaattagagcatctagaccaaacaatatcataggcaacctctatgtctttttgaaaaatacaatataaaagatgacttgcagtgaaggaggtagtcctctttcatgagacatgtagggaataaggttgaatgatcaactaatgtcccaaagtctcacatgccatatggaatcagtatcatgttgatggtttggagaatttcctaggaatgcagtctgtggtaccaatattgccctttccgaaggcttaggggtctgcctttatgatcaaggcttttatctgcattacagttcctggcacttgaaagcttctgatatattggattatttgggattaacattcagcatcaaatagtatagaacttcatacctctctcatggcatggtccggacattagcaaggcgggacttgtgcagtggctccattgtggcagggagtcagctcattctagctcattcatgtaccatgtttatagtccctgtggcaaagaagactcatctccccattgttgtatcacattaagcaaaaatgcaaaaagaaggagaaagcatgctcattcttcttaaggacattgcctggatgttgtataagtcatttcggctctcattcccttttgccagaacttaagttacatgaccacacctctttgcatgttcccatcaaaaaaaacctagcagtgtatttcctagagaagaatgagacaatagattttggagaacaaccagcagtctctgctgaataacaatattttgttaaataaatgagaaaagctaaatcaaaataaaacagtgtagaaatatattacccttaagatcaccagatccaagcctttaatgatcttaatggaaaagaacacagatctagtattccagacatccatgaacttttatttcaaggatgtgttgctatggggcacccttcatttgctggcagtaacctgaaacctgggatgaaatgaacatacctgaaatctctgtcactcttctccctaaaggtcatcagaggagttgcttctacaacctaagaggaaggatcattaatttcttaatctgtctaagggtagatcgtcacttacctggaagctgttttataaagggaatatgttagaatggtagacaatattagcatttttcaatatatgattttcatttcctttctgagctgagatatgaaatgcccctgtgcaacttcctatttaacttacatcccagctgaggtcatcttagagggtaccttgtattttgggatggtggaatcacaacatccatctagtaactagcttactagacagctgccctagagagtcattcacatccacgttgatattgtttaagcgcctaaacttttgctgtattagggtgataagatttagggatttctggttcctgcatatgacgcagtctatcctgactatcacattttgcaagtacttatcagcctccaggtgtaaacagagtcattgattatggagtcctggaattgactagaaataggaaaagtatttactctcaaatatcttaaaatgtggctaactcatccaattatagcaactcaaggtctaattgtaagccaagtcttacagaattgtgttcttaaaacaaaagagtgattagtgttggatatggttcatctgggaagacttcctttaacaggaaaaaaaaatcactttctccatctgtgctggaagaaagtaactcaaacacagtcaggaacagagaatgtatgcaatgtaaatggctaaacctgacagcctctggctaattggaagtgtcggtgttattgtgcttaggttaatggggctctttagtttaccatctgagctgcttctcccaaggaatcacagcaaccagcagtctccaagggctcaaaaaccctggaggacttctctttggtccctgggagctgcaccctgggcacttacagcaagctcacaggtgatgagaactcatagttcagcattttgcttctcttctatgaaaaaaaccgactgttttcttcataaattagacccagccaaagatcttgattcttccattattctttccaaacagtgtcataaaagagaagaacaagagggtggactagggacctctgacttctgacccttcctccttaagcagcctgatatactctgcaggctgcccttctgatggccacagatgacaggaagagttgctgaaaaaaaaaatatgggcttaaccaacattcacagaccaactccatgcctggcagtccctgagccacatctttgacttatgatattagaggagtattatgggccattggtttagattctttatgatagcattgacatgtcatagaatgtcagctggggacttaaggctcatgatagctcaagatgacataccattaggcttagactaggcaacaagtggctattggaatgatgggacatttataggagagcaggtaagatcagatttcttccaagatacattctttctcctgtagaggcttttgtcatttcacttatcccactgaattactttccctgttgtgttaggtatgcctcaggggcagagaacgtaatacatttcacttttaggttcttggtgcctggaggagtgtgtaatgcatagttgctgctcagttaataatgtttgtattgaatggaaataaccaagagtctttggtctagagaggaggagaatgaagtgtcatgatcaagatctgttaaatcctacatggggaagactaggttgaaaggggagttagttgctaagtcctaaatacagagttgggagactcccttttgaaaatggatcaaggtaaatttaggaccaatacaaagatgatccagtttccacgtcaggaaataagcttctagatctcattttccaaaagatgatagtggaaagaagcaaatgaatttttgccatagtatatttcaaattgaagaatggcacagcttttaatagcttagaactgggtgcagtggctcacacctgcaatctgagctacttgggagtctgagtcaggaagatcacttgaggctaggagtttcagaccagctgagcaacatagccagaccctgttgccaaaaaagttttttaaaaaattagccaggtgtgatagcatgcacctatagtctcagctactcagagggctgaggcaggaagattgcttgagcccaggagttcaaggctgcaatgagctatgagtgtgccactgcactgcagcctgggtgacagagtgaaatactgtctcttaaaaacaaaaaaaaagaccctaaatgaaggcttaatgtagacctccgagatggacagcctgagcctccaatgactcattttttagcattagtgacaataaaaaaaattatgtgtatgtgtgtataggcatgtgtcacttagcaatggggatacattctgagaaatgatagatgaaattaggtgattttgtcattgtgtgaacatcatagtatatgcttaatacaaacctagatggtatagcatgcaatacacctaggccatatggtatagcctattgctcctgagctgcaaacctgtacagcatgttcctgtacagaatactgtaggcagttgtaacacaatggtaagtatttgtgtatctaaacaaaaaaaaagttacagtaaaatacgatattataatcctatgggaccaccatcttatatgtggtccattgttgactgaaatatcattatgtgatatttgactgtatatgggactggtcaaatatgttttccttttctatgatggcctcagagccatcatagactatctataacttcatctctaaccattctttcatgtgaatcttatgtcctagggactttgatctacacattgtactttagacagaccatttaacctgcatttattctcttttccttttcctaccccctttgcctccttcttcctggtaaccttcatttttgctttcctatataaaaccttctaaaccaggcccctttgacctctctcttcttacgtactaatggcaggtgtagactttactgatggtttgctgatagctgcctttaattattatttatgtttttaggcacttattctacttctccaaacttaagactagtgaatacatggtcctttgtgatttagctagagtagaaagctcagtcttatgaaatgaaaactgatatattttttaaagagaacgtactacgaagaaacaacaaagaattaataaaaatgttaaaatcagtaacatatcactaacaatattactaaagatgcaaccattagattttaaaaatctaatttaatggattgacttgttgaatatcagaactgcaagaaaccttaaagatcatcatgctgaattcttatctcatactggtagatgtacaactccaggacaattaatttagtggtagagttaaaaatgttattccttctaataacctagaaattctcatacatatgtatatgtcctaaagaagcttggatatattcataaagtaacattacagagatatctactaatagcattgttttgtgataatgaaaaatttgaagcaaaataaatgttcattaataggaaattagatagataaaatgcattctattcatgagatagaattctagacagaggttaaatggatcaaaaggaataaaacttaaagaaaatcatatggtaagtagaatatgtacaagctcatatccattattatcaaaacaatgttatttctggatgcacatagatgttgaactttaaaaactgattcgtgttctttattttttaatttggaaaaatataccttaaagtgattatgctgaataaaacaaccatctaacattcttattttcaaataaggaaatgcacatcaagagttgtgcttggtgtatggaccatgtttggaccctattttgaaccaaatgaatattaaaaactttatgagtgccacatcttctgtcatcagggaaatgcaaattaaaataatgagataccactgtgcacctattagaatagccaaaatctagaacactgacaacaccaaatgcggatgaggatgtagagccttagggactctcattcatctctggaggggaaacaaaatgagacagccactttggaagatagtttggtggtttcttagaaaactgaacataacttagcttatgatccagccatcacactccttggtatttactcaaatgagttgaagacttatgtccacatagaaacttgcgttcaggtgcttatggcaactttattcataactgccaaaacttggaggcaaccaagaggtccttcagtaggtggatgggaaataaactggggtacatgcagacaatggaatgctattcaacactaaaaagacatgagctatcaaaccatgcaaagacatggaagaaacttaaatgcatattcataagtgaaagaagccaacctgagttatatgctgtatgattctagctatatgtcattctagaaaaggcaaaactatagagagagcacaaagagcagtggttgtcaggtgttatgggggaggaaaggatgaataggcagagaacagaggatttggggggcagtaaaaatactctgtatgatagtgtgatgactgatacatgtcatgtatctgtctaaacccatggaatgtacaacaccaagcgaactctaatgtaaactatgagctttgagtaataacgatgggttgatgtaggttcatcagtgtaacaattgtgccactctggtgggggatgttgataaggggggaggctatgtatgtatccccccatttcccaggggtatatgggaaatctctgtaccttcttctcaattttgctttcgaatttaaaactgctctaagagaagtctttttttttttttttaaagggaaatctgaagcaaatattagaaacatattagggtggtagattcacatgtgtcattttatcttgtctctggaccttaaatattttataattgaaagtaaaaagttcttaatgtaaaaaaaaagactgaaatgatcagggaaatctgacactgactggatatttgataacagtaattataagcttttttaggtatgacaattgtggttatatttaaaattttttttcttagaggtacctaagagtatgtatggaagaaattatttgatgtctgggattcattcaaaaaaaatttgcttgggagaagagggaatagatgtgagtagatatagttgaaactagattagctgtgtgttgatttatagatacaagagggctcattatactgtagtctctatacttacaatttttttgaaatactcccgccaaatttaaaaaattggccttaaaatatagttttagaaccaatgctccttatccagtgctgtttacaatctatctcattgagaccatgataggttggactctctacactggccagagcaagaaagggtacataagcaggttttgcttacaattattttcttactggaggaagtttcgtacaaagagtaatttttatttatgaaaagcagtcccccgttgagccatcagttctagttgaggtgtatctaagatttctttttctttccaaacatgtcaaagcaaccaagccacgtgattgagagtgtgggggcctgaaacacccgcaagcaaccgcaaggggtgggaggttactcattccaacttttatgatgtcccgagaaacggttgcgataagagaaaagactaaaaaataaacgagagataactgagataatgggaaaaacagagggaaacaagacaacactctccagtctttggcttgagatatttattatgccaagggagataaattggagaaacatgaaaagggaaagagatcttgtctctgactcacgtatttctctttaagtgaatgagcaataacaccggaataaaagagctcaaaacagagccatgtgctcagccaaaatcatggttcctaatgaatttcaacgttggcagaagcctcacacgttgtacttgaacagctttcttgattttgaattatacatgtaattcatcctgaccagaatgtagcctgagagccgagatccgaatgtgagtgggaaatgagaatgctggtcacgtgctagagccggtctttcttcttcacgtcagaaatgtctgtgctgtcatcagtttggacagttctgggaaacaaacaaacaaacaaaacttaggaaatcaattgtttggagtcatcttggcaaatacattgtcatatgacatattttcttttcctaccaggctgttctgtattagaaagacacagcccaagatagtcagactacaacgcatgaaacaaatgttgatgaacagaaagggtcaccgatgaggccaacagtccaaaactgtccacctggccttcctgccctgtcttttaacaggacagaggaggatgaaggggaacaagatagacctagatgtggtggcaccttagaaaatttaaccaaaagaagggctgttgttttgctgattctactcagtgaatgcagtggaaagaaaatcagattcagtgggaagaaaatcagattctgctcgctctgtttttaaatagtgggtgagctttagctcacatttcatagagcaaacttttttagggtataaaataatattctttagtaactaaatttacagtctttgttcactgtaactttgactttacttctgaataactgcagctgacaggtcatttctgactattacatgtgttttttcttgagttcaagctaataacccaaaatgttagtcaatcctgcaagtgttatttgcatgtccttaggttttgttaaggtacttcgtgctgtggtgtttactttgggatagaattaaactgttgtgggaaggtgctttcaagaaagtgcttacgagaacaaaagttgttttgaaggtaggtaggtaggtggagggaagaagaaaggagagagagaagggaaaagatcgctggcagagttggaaaaaccagtaggttccaatcccaaatctaccatttactagccctatgaatttgggcaatttatttaacaagcctctttgatcctgtattagtcaattctcgcattgctacagagaaatactggagactgtctaatttacgaagaaaagacatttaattggctcacagtcctgcagcctgtaccagaagcataacacagccatcggcttctggggaggcctcaggaagctttcaatcatgacagaaagtgaaaggggagcaggtggatagtgggagcaggagcaagagagagggagatgctacacacttttaaacagccagatctcatgagaagtcacttgttattgcaaaaacagtaccaagaagatggtgctgaggcatttgtgagaaatccatcaccgtgatccaataacctcccaccaggccccacctctaatcctgggattacaattcaacatgagatttggggaggacacgcatccaaactatatcagcccctcagattatttatgtagaaaatgcaggtgatcactacctaccttgttgtgttgttatgatgattatagataatggcattatttttaaaagaaaggaatgaaagggaaagatacatattctaaaaatgaaaaatctcccaaagcaaatcatatttataggtctgttgctataattccagattttaattttattaaatgttcagaaaagaacaaatcacagatccttggttccaaataagcacatgggaaattatgtgaatattattaaaacgtgagcttcttgtgacaatagtgacattattggaacataaatggcagctcagtcagcgtctccttgtaactatatcaaagaaaagacagttgcagctttgttctctgtgtgacccacttggggtttggctgcttgttgatggatattatcatttttaatgtcagtaaataatgtgatgtcagataaatgacctgtttcctttctgtggtataaagctcatttatctttagggagcttgagtgtgtagagaaatctgagtgggaccaagggtttctgactatgcaggatgggactttttttattaatcctgcttaacatgagtcccaggcagtcacattcaattctaaatgtatgtgtggtaaatcaatggaagtgatatgcatttaccatagactgttttactgattggagaaaaacagaaagtaaactttttttttcaacttgaagaaaatgatgctatacataaagcattactgtgcacgtgcatgtagtagacagaagacatctttctatgtaattcatacttggcttagctagacccttgttgctttaaggaattacggtggtataaaattaaggatcaggaagatgcattttaattaactttactgctaatagctttggagatcacaaaaatgtgaactatggtagagtcaaaaagattctgagatcacaggaaattatgattttgatttctgggctgtagtatctgcttccttcctaagatgaccactgaaaagtccacatcttttatttctgaagatgagtctcatgaatccattgtctctgtttttcatgactgcacatttagccaaagtcactggaatgccatattctctgatgggagatttagtcagggcaaaaaagggccatttgcttttctggaaacctttagacagggtgacaattattccaatgagtttttcttaatattgtgagctcattttgaaacacttccttaaacaaccctctgaagtttcctaggaaaattcatggactctcagagaaccaagtctggaagcctctttagaaatcatttaattaaaatgtttgatttttttttccgatgagaaatcagaggtaaggaatttgctctaggtcccaaggtgagtttcctgcataggagactgaacacaaaggctttgtgtttttactaaaacattattgttttgtcagatattgaaatgtccactgatgatttaatgattaaaactgagaattttttagatttacttttctcagttccatcatattatagagctggcagagagggtagagtaggtatttattttactacccaatgagtagtctcgagaaagacagtgtccacctgttttttctagaataggggttggcaaattacagcccataaaccaaatatggccagtggcttgttttttgtttgtttgtttttacatatgagctacgaatgctttttacatttgtaaaaggtggcaaaaaaccacccaaaaaacaaagaatatttgagatatgtggtgaaggccatgtgtggtctgcaaagaatgaaatatttcctatctggccctttacaggaaaagtttgccaatctgtgatctaaaatattcagagaaaggttctgtgaccttccttgtagatcccacaatacttttgtgtttatattttttaaatgagcatcacagattgcaggaaaataggaaacaatttaatttaatttaatttttagccttgaaaaaaattccttttattgaatttatttatttttccagctgtaaaattggaggcaccactcagaccttgtttggctctatcattttatgagtttatggattacaacagtgaacaaagggcacgtgtatcagtcctttctcatgtgagactacgtaatttataaagaaaagagggtttgtttgtttatttgtttttgtttttgtttattgagacgaagtcttgctcttgtcccccaggctagagtgcaatggcacaatcttgtttcactgcaaactctgcctcccaggttcaagcaattctcctgcctcagtttcccaagtagctgggattacaggcacctgccaccatgcccacctaatttctgtattttaagtagagatggggtttcactatgttggccaggctggtctcgaactcttgacctcagatgatccatccgcctcggcctcccaaagtactgggattacaggcgtgagacgccatgcccagccaaaaagagagttttttttgagacagagtcttgctctgtcacccaggctggagtacagtggtgtgatcttggcttactgtaacctctgcctttgggttcaagcaattctcctgcttcagtctcccaagtagctgggactacaggcatgcacgtccatacctgactagcttttgtatttttagtagagacggggtttcaccattttggccaggctggcctcaaatgcctgacttcaagtgatctgccagccccagcctctcaaagtgctgggattacaggcgtgagccattgcacccagccaagaaaagaggtttaattgactcacagttcctcattggctgaggaagactcaggaaacctaccatcatggcagaagaggatgcaaacatatccttcttcacatggcagcaggagagagaagaatgagtgaaggaggggaatagccccttataaaaccaccagatatcgtgagaactcatgatcatgagaacaatatgagggtagccgcccccattatttaattatctcttaccaagtcccccccacaacacgtgtggatagtgggagctacaattcaagatgagatttgggtgggaacacaaacaaaccatatcagcacactcattcagcacatattcagtgggtatcgagaggctatgctggatgctttgggtaggttggtgaacaaacagtatggttcttgcccttctagaccaatattcagtgggaatacagagggaaagaagaaataatgaagtaaacaatgatgggcatttgtagcggttaggcaggattcagtgtcagataactgtcaaggggaaattcctgagagactccacccactgatcatttgtccgatgtgaagggcaatttatcctaacttccacacatatttatgggtcattttctatgtaccaggcatgaggctgtctgttaggttgagttctcagtcaaaaccatggacaaaggcctccttttggacattttcccaaacctgcttggttctttgttaaaatggtacttgttccaaccttcttttgtttgtttttaacttttattttaagttcaggggtacatgtgcaggtttgttatataggtaaacttctgtcatggatgtttgttgtacagattattttgtcacccaggtactgagcctagtatccattagttacttctcctgatcctctccctcctctcaacctctaccctccagtaggccccagtgtctgttcttcctctcttatgtgtccatgtgttctcatcatttagctcctacttatcagtaagaacatgtgatatttggttttctgttcctgtgttagtttgctaaggataatggcctccagcttcatccatgttcctgcagaggacatgatcttgttcttttttatggctgcgtagtattccatggtatatatgtaccacattttctttatctagtctaccattcatgggcattagggttgattccatgtctttgctattgtgaatagtgctgcagtgaacacatgaatgtgtatgtcttgatgactgaacaacttatattcctcctaggtcgaatggtagctctatttttagctctttgagaaatcaccacactgctttccacaatggttgaactaatctagactcccaccaacagtatttaagcattcccttttctctgcaaccttgccagcatctgtcttattttttgtttgttcgtttgactttttataatagatagccattctgactggtgtgagatggtatctcattgtggttttaatttgcatttctctaattatcagtgatgttgagctttttttcatatgcttgctggccacatgtatgtcttcttttgaaaagtgtctgtgtttcttgcccactttttgatagggttgtttgtttttttcttgtacatttgtttaagttccttatagatgctggatattagaccttcgtcagatgcatagttttgcaaatatcttctcccattctgtaggttgtctgtttactctgttgatagtttcttttgctgtgcagaagctctttagtttaattagatcccatttgtcaatttttgcttttgttgcaattgcttttggcatctttgtcatgaaatctttgcctgttcctatgtgcagaatagtattgcctatcttgagttaatttttgcatatgatgtacggaaggggtccagtttcaatctttggcatatggctggccagttatctcagcaccatttattaaatagagaatcgtttccccattgcttgttttgtccaatttgtcaaagatcagatagttgtagatatgtggccttgtttctgagttctttattctgttccattggtctatgtatctgtttttgtactagtgctaggctgttttcattactgtagccctgtagtatagtttgaagttgggtagtatgatgcctccagctttgttcttttttgcttaggattcccttggctatttgggctcttttttggttccatatgaattttaaaatagtttcttgtagttctttgactaatgtcaatggtagtttaatgggactagcattgaatttataaattgctttgaacagtatggccattttcatgatattgatttttcccatccatgagcatggaatgtttttccatttgtttgtgtcatttctgatttttttgagcagtgttttgtagttatccttttagaggtctttcacttccctggttacctgtatttctaggtattttattctttttgtggcaattgtgaatgggattgtagggaatccaatttcaaaagaggcctacttgggaccaattttaggaatagtttttgtcctcaggaataatccacctgctttataaattatacattaagccctgagctaaaatatgggcaaatctgtctctctcctcttccatagaacttttgctgacttgttagccacaggactttgaattatataatttctcatcaaaaccacatctatttcctgaaacacttcaaaatagctttgactcctaggaaagtctggttaaggagttcagacaccaccttagtggaagcccatctcagtgacaccagatttcctatgttgattgggaagccatgctctgtgttgggagagaaaaaaacatgccttgtagctagaattatgcccaggggtcctcatggcttctgtttccagagctgggcaatggccatcctcagctttgccactactgttttgaacaactttgctcaaacagaagcattgttctggaacttggcgaacttggtgatgatctgaatcatcaatttcagtttgttttaatctggtactgagtttaaagtttaggtagttcaagggtaaagatagcaaaaaaaggaaaggaaaggggatgatgagtagatgaaactgtatgatgagtagatgaaaggggatgatgagtagatgaaactgtatgatgagtagatgaaaggggatgatgagtagatgaaagatgttttactaaaaacaattggtaaaagttgtcagatctatttccatatatctcttccacacattcttttgctttatgttcttaaaattacaatagatctcattttatccttgacattggaattctgaaacatacatgcattccatgaagtccactgtttattgttgaagccaataagtaagacagaacaaaagcaaagtgaagttagaaaggtatccactgtataggtactttacaaattgtgggtaacaaggtggggagaaaagaaggacattctaggagggaaaaagataatatgtattaaggaaaccatattatggggagttaagaactatgaaaatcagtctttctttccttagaatagctcttttcagcctgccccatagtaattctaaaattattggcaggaaaatttggtgcaggcacagcaattagattgaatctgttgctgataggattcttcggcataaaactggatctttttgctacaactaaccattcattccacagtgctttcagttcccagaataattcagctcaagggaatattgacatttttgtctgaatccattctgagtttcatcctataaggaaaacatttttaaatactcttttagccatggtcttgggagcccctgaaatattctttccctcacagatggcagtgccttttcctgctgcctctcgtgttggatcttctctatcccacaggagcagacgggatgttggagcccttctgttagagcagatgggaagttggtatcagggctgatggttaaatcactgagaccctacattagcatgtctgaggaagacagatttgaggctgtcttcctaagaattttctttagtggtcattaaggaagactcagaagaaagattgggttaatctctgtaataagcccatagtggaggcctaatgacagtcagaatattttctggtctcatgggtcttcaaagaaagcaaactcaaggtcctaccaagttcagtgttttcaaggttctaaaaaattcaaggttctcaagggtttaaaagctagtgaaaaaagattacagcccagcttagtagaaatggtagactccaacacattgggtgtgataggagaattcttcattgtcatttgggataggacagctgtttactgtgaggctgccccatgcattctaagaggtttacctctcagaggtttatcctcccatcacccaagggtatggccttacccttggatgatggccatttctccagtgaagtttcctgtagcctgtgtcctagagtatgcagagaggaagctgaaaggtaaaataatcggaggattggactacagactttgagccagttgtttaaaagattctggtctccacacatattgcaggtcacattcttgctgtacagaattcaggagcggatcagggctggaaaagtaggaacagtctcctcaccagtcacccaagaaggtataaactggccgctcaatgtgttttagactcatataaactcagaattggtagaaaaccaaaactagctcatctaaccaactgctcagtagagatgcctttgccaaatgggcatgtctttaagatataaccataggtatatggtgaagtctgtgccagagatttatgttaaattcttgcagattcttgtgtaggtgctctcagactggtctctaggaaatatggtaaatttgtttacagtaaatattggctaattgactaaaagtaaggcttctagagtttagttcctgcttcaaccactaactagctctttgaccttaagcaagtccgtttgcttctctgagtctagctcagtttctcatacgtaaagcagagataatactgctaccaattttggagatttaactaattctgccctaaaactcttcccttcaaaagcaatggtaaaaattattactggagcataagtaaatgtttatcatataaaggaaactatatctctagaaatgttatacatgtaaaattttaaaattctataaaatggttggtttcttttagaccttttagttttgtgatattttaatccagaaattgaactctggactgaagttcaccttctcttatttgaaaatttatatgaggttagagaggaggaaaataaactaaaaaatattatctgttactactaatcttgcaaggtatttgtggtattggtattcaaggagttaataaatatgaaatgcttagaagaatacctagcacttggtaaatgtacaataaatatcaactattatgagtatatgtactaaacacagcactaggttaatatctagttttgtctcatagatggatgtgcattgcttcctatgaagaggcaaaagtttgtactgatctgagcagctatatctgtgcctagagaaagaagctggttttaaaaccccttgtccctaagtttgtagtggaatgggataagtcatctggctcttatgctatgcctacccttcagatgacactatctcgctgcaacctctgcctcctgggttcaagcaattctcctgcctcagcctcccaggtagctgggattacaggcatgcaccaccatgcctggctaattttttttgtatatttaatagagatggggtttcaccgtgtcagccaggctggtcttgaactcctgaactcagttgacacacccgccttggcctcccaaagtgctgggattacaggcgtgagccaccacacccagcctatctttgatacattcagaaaggaaagggaaggaggcctttctcctcctacctcctgtgagtggttaggctgggttcataggaagctggccaagctcattagcatggcaagcccctccactacccactgctctggcctttagttgcatactggtcagtaagtggaaaaagggaagggggaggatttgaaacgtaaccacagcagggattcctggaggctgtgggtgattctttaagttggtgcttctctttagggcatagcaccaacgtcttcttgtgagtgtatcctaaaaagtgagcaggtggatttctgctccaagccatgatataatgacaaagactggatttaccttcctgccttatacagttaagaaccagacaaaatatatgaaacaacagtgtcttagtctggttagtgtcgctctaacagaacacctgaggctgagtagtttataaagcaaagaggtttatttggctcacaattctggtggctcagaagtccaagactgggcagctgcatctagtgaaggcctccctcatactgctcccactcatgatggaaagcagaaagggagctgggaatatgcaaagagatcacatgcgagagaggaagcaaggaccccagactctttctagcaacccacggctctcaaggggactaatctcttcccaccagagtgagaactcactcaccactgtaggaaggcactgggcattaatctattcatgagggatctgcccccatgactcaaacacctgctactaggtcccatctctcaacactgccacattggggatcaaatttcaacatgagttttgtcagggacacaccccatccaaaccatagcaaacaggttgcaaatattggacaataggtagcacagaacattgatcctcaagagaagaacaaacagggtgagccctacaattgctccagcccaccatctacagagtatatctagactgcagtgcagggagggccaactcaaacagtcctctggtctccctgagttgagatgaagttgagaattaggggagaccaaagtggctagaattcccagggaagaataccagaaaggagagcattaatggagaggagagaatattttataaggggtatctgagtgcttactgatcagagcatgatgtgaggaaactccctgaagcttggggaagaaactctctaaaggagcagatggagcaccctttggagctcacacaggaccagaagtagtgctgttgccaccagctggagcagaaaatcagaatatacagggcatccagtagactactcaggagagtattgtctcaatagtagggcaagattaaagagtgctgtggtcctgcctaacaaaacctaaaaacaagcttcaaattgtttacaaacacttttctttgtcccagaaataaaacacttcacaaatatttaaatgaatatcagatttataatatctggcatcaaagaaacatgagaaatatgacccaaaatggggagaaaaatttgatcaatagaaacatacacagatgatagaattagtaaacaaagacattaaaatagctattataactctatcctgtatgctcaagaaggtaaaggaaagcatgaaagtgttaagaagataaaaaaaaagataatgagcatcagacccaaagcaaaattctagaggtgaaaaatgccatgtctagaccaaaagcactctaggtggaattagtggaagattagacactagcagaagaaaagattagtgaacctgaaactatcgcaatagaaatcattcagaatgaatcagaaaaatcactgaagaaaatgaacaaagaaactgtgagctacaggacaacttcaagctgatggatatgtttgtaattagagttccaaagttatcagaagaagaaaaaaaataaaggtacaaacagaaatcagtgaaacagaaaagagaaaagcaaaagagaaaaatcaatgaaaacaaaaccttgttctttgagactattaataaaattgataaacctctagcttaccagagtgataaggaaccagatagaaggcacagattaccaatatcaagaataaaagagtaaatatcaatgatgttgaaaatgtaattaggaaatattatgaacaactttatgccaataagtttgacaacttggataaaatggacagatttcttcaaagatacaaactatcaaactcctgacaagaagaaataggtaaactcaatagccatttataattttttttttgagacggagtctcactctgtcacccaggctggagtgcagtggtgccatctcggctcactacaacctccgcctcctgggttcaagcaattctcctgcctcagcctcccgagtagctgggactacaggcacgtgccaccacacttggctaactttttggatttttagtggagatggggtttcaccgtgttagctaggatggtctcaatcttctgacctcgtaatctgcctgacttagcctcccaaagtgctgggattacaggtgcgagccactgcatctggcctgccatatgtcatttttgaaaattgaatttgtagttaagaatcttcccacaaacaaaaccacagatctaagatggcttcactgatgaattctaagaaagatttaatgagggactaattctgattcctcattaacttttctagattattggagagaaacatacactttccgtttcattctgtgatgttagcattatcctgatatcaaaactagaataagattttatgagatacctcagtctccatgaagtgcttatttcacattgcatgcctgtatcaaaacatatcatgtaccccataaatatatacacctaccattacccacaaaaattttaaaaaattaatttaattaaaaaatttttaaaaaattatgagaaaattaaattctttccaatatctcttatgaacaaagatgcaaaaaagttttaaagatttttttgtaagtcagattcaataatatgtagaaataataatgtatcatgaccaagttgggttaattctaggactacaaagttattttaacattctaaatgtaaatagggaccttttcctaaaaggaaaacattattcttctccatcttatcctcattgttgtagagcactgggttttctttcttactgtgatgggtaaggaaaggcctcaggtcttaggggatctgctaatgagctaagcagaaggtccctattcatatggcctcatatttgtcacccagagggtagcaacaatctaggacccagcgaccctcagaagtgtgtgagacttgggactagcggaaacagaatgggttttggagtcagaccttggttcaaatacaagtttcaccatttgttgaacaaattatttaatgtttctgagctttagagaaattatgaggattaaggccgggtgcggtggctcacgcctgtaatcctagcactttgctaggccgaggcaggggggattgcctgagctcaggagttcgagactagcctgggcaacacagggaaacccaatctctactaaaatacaaaaaattagctgggcatagtggcgtgcgcctgtagtcccagctactcaggaggctaaggcaggagaatcgcttcaacctggggaggcagagattgcagtgagccaagatcgcaccactgcactctagcctgggtgacagagcgagacttcatctccaaaaaaaaagaagattgttctgaagctcagaggtgagacacataaagcccttggcacatagcaagcatgcagtgcatggtggctgtggtggtagttcattttgttgagaccctgtagcatgaggtttaagagctgtgggtctggatgaggatagcttggattcgaacaccagctctgttacatttctgtttgtgagaccttgcctagtttcctagtctgtgaaataggattaacagtactatctatctcaacagagttgtgttgtagtgaagttcttttgatacatgagtagctcttagaatgatgcctggcccactttcaagtaagtgctcgcattaactattattttaatgctattatcgtttctctggccactggtgtggtcattactgttgttaacaggccagataagggtctgatattctagcaagaaatggtcctagcaagaaggattcacaaaccaaagtgaggacaccaggtaacagagtcactgagtgctcgagtttgctcagcctccagattttatttggctccgttgaaagcagacctgcctggccctgactcatcagagaaagctgaattgctgcacctgggaagagtgaagccttggcgggcaagggcagggcagaccctgcaaacaatctatctcggagacaggaatattttgttagagatgcgcccagttggggttgggccttcctgaatggtgatgggatgcagtgtgaatggagacctgggctataattgagaaccatgtggccatgtcagcaggtgatggcacttgagtgacagtatgacagagaacagaaacagggccacagctagccgctctgcctgccatagcgatgtacactgtgcagatttctacccagccaggaatgagccgggcctggagaggcctgccagacggtgggctgcatgctaccaatttctttcagcacctcctattttgccattcatagactcttgccattaagcagacagaacagctcatatcctgtggacagatgatagatatgtcatatcactgaaaaattgtttgtcttccacaggtgtatgggcttcttctaaagcaggcagctcacatgacacttttcaacactctgtcctgtaccagcttggcatccggcgtctatcaaaaggggaatctttcatatgcaattatggcagaaaataaaggtgatgaagtgttgtgtaccaagaagggataagatcaaagggcggtaatgaataccgattacaatagaagggcagcttcaactgcagaagttgtgtgtgactgtgtagaggctggcgctgcttgggggcatgcactggcacacaccagagtacatgcagaaataatacagtaaaatcataggcactgctgtcataaaattataaattgccggctgggcgcggtggctcacgcctgcaatctcagcactttgcgagattgaggcgggcggatcacctgagttcaggagttcgagaccggcctggccaacatggtgaaaccccgtctctactaaaaatacaaaattagccgggtgtggtggcaggcacctgtaatcccagttaatcaggaggctggggcaggagaattgcttgaacctgggaggcggaggttgcagtgagccaagatcgtaccactgcactccagcctgggcaacagagcgagactccgtctcaaaaagagaaaaattataaattgccaaggtagaccgtaacccaagaggggttacaggtaatgtgtaattgtatcaaggtgatggtaagacacttgtatcctgataattcacgtaatacctgtttcttccagcaccatccaattagtggcaccatttcagacctccaaaagtctagtttatacccattgaggctgattttccaatagagtcttccagagcacaggacctgggcacccaatggtgtgttgtttatttatttttttattgcactctgggaggccaaggggaaaagcacagcctgttcaagtttaggaacagggctgcgtatcattggagacttcacagccatgcagtgtcgccatcccagcagcacgctttttaatcggagaagaatttctctacctgccaagtacttttccttgcagctgctatcatcttgaaaggtacatcacatgatgacatttcaaatcccacaaaatggcttgcccaagtcaattcagcagaggctttaactttaatatctgatcactttctttggaatgctatatgaaaagctgacaattttcaactaatttgtgagtacaccagtttgagttggttaaaaaagacaaaaaaaaaacaacaaaaaaacctcttcattatagattacttaaaattcctttctaattgtattagtttcagtaatgatgactgcagtaatttaaaggaagctagcaaagttttgtcaaatgcctttcagggttcttgctttaatgggaaaattaaatcttctttatcagttgtagtaaatagatgctcaactctttgaaaatggctcctttttctaagtagataaaaaaaatcctgctttgtcttattttaatattggctggattagtaaccattttgctccttttgcaaatataaaaatatattgagagacctcccaattttacaagtaagaaggcctacatcaatgaggattgaggggagagggaaagagaaccagcataggttgaatgtctgctatcttatttaacttcatcttcacaaaagctgtttgttggagatgatagagccattttccagatgagaaaactgaaatgaagtaagctggtctggtctgtccagtggtgttagagctgaattgaaatcctgctttatagagcccccagattggcattccactacctttgctcccccatgctgcttagctcacattggctgtttgccataggctgtctttctctaaccagaagctgctggtcttgtagcacccagagacttgtgcaaatgtcttctgtgagcaattgtaattgagatttccaaatgaaatgtcagtctgctcaccaggggaatagtattacaaagccagtggcccttgcgataccctgtgttttcacagccctcagggccttgtgttgaaaatgtaagcaggcattgctaagaggtctcagtggggctgagtgagcaatgcttcttgcggggaactttatggtagaccaggccaaccatgatgaggactacctggccagctcagaaaggcttcttggtgcaaatctcactcttaagttcccagtgaagtcctctttgtgtcttcgtaggtatggtacatggctgtaattgaatacattaatcctgtggcattttcacccattagcactgcagcataagtccttagaaagaaccatgttttgaggaaaagtgggcacggggaagacaaattccaatataagaaggaaaggagagcagtctgcagtcaaagaggcattccagagggcactggatggtggtagggaaacagggatcctctgaactcagttggggtgaggaataggagaaacttccctacttgacaattttgcctaaggccagctctactcagtaagcctcctgggatcagcttgctcacttcaaaggatctagaccatcagaagaacaaaacaatatttccctctgtggcaatgtggcattgcagctgtcatcacaattgtatccagaaaagcagcgtattcaagtggcagcttgttccttgaggcttgtctcatctttgagaaatacccagtgacacctctcagaggaaatccctcattccagctctgtgtgatcgtttctgcaggcagcaagcactttaggaatatgttcctgggcataatgagccctccgatggtgttcaccgtgtttgttcacaagagaacccagccagagttttgtgagagaccagacagagcttcttgagcccagcaacaggaggcacagaagaatttctggttgtttccttagacttgtaagaactgttatttgaggacttcattgaaaccagtctttatgtccccaccctttccatttccttttccttttaacccacagactgctgttcactgttgtagaatggagttgatgactgattaaaaaaaagtttctgcaaccttccattgcatgaaaagaataggatgcaatcaaggaggggggggtggtggaggagtagaggacatttccctgttctctgctctccccaccttggacttacagaatcctagacctgaaaggagctttttttcaagcatgtagctggcctaattctcaaactgaacagatgaggaaacggaggcctagagagtggaggtgtttgcctcaagtgacactgatggctgatgaccagttccatagctggcatactttgttcagctctgcagacgatagtttaaggcaaggacacatgacaggaggatggctgggaggatcgggagcttatgacgatgttttgaagaacccaggactgtcttgtcggtaagaaagaaaatgcttcaagggattataaagaccatcctcaaacatttgaaccgtttccacactgcagcatagggagatttattctttgtaattgctaagggcacagctagaatccacggacatatttatatgaagagcgagtttgactcaagatgaggaagatgttgatctgccttcaatatgagcctggaatgcctgaaagagtagtgagtccactgccttggaagaaccaactgtccctcaaaaaagaggacatgttcaaagaggtttctacatggggaatctccttttcaaagctaaagtgaatcaacaagattctcatcagagtccctaagagtccccatcaaatagggaggtaagtggaattaatgaaaaacgctgaaggtatcagtttctgcaaagccagtcatctccagagcagtgtatgaatctagatctaccacaggctttggggtcgttagctttcgctgttgtggagcccagataggggatagctttgaaagtaagggctgctgctacttataggatgaaagtggaaatgcgttagtttcgattttgggtaaacttgatgatagggaaaaaaaaggcacccatggctgggatctctagttttagtccaaaggtggtaaatcagtcccaggatagaaagactcctgtgagcccagtagagaccaggcctcagaaaaagccatggccactgctttggaaaaaacttttttttttttttttttttttttttgagacagagtctcacactgtcaccccggctggagtgcaatggcgtgatctctgctcactgcaacctcccaggttcaaacaattttcctccctcagcctcccaagtggctgggattacaggtgcccgccaccacacccggctaattttttgtatttttagtagagatggggtttcaccatgttggccaagctggtctcaaactcctgacctcgtgatcctcctgcctcggcctcccatagtgctgggattacagacatgagccactgcacctggcctggaaggaacctttaacagagacttttatagatacctctgaggtttaaaggccactaaggagaagatccagggcactggaatgcctgaaccccagaatgggctgatgaaataaagtcccctttacccctggttccatcacactggcctgccctttgcctgttgtggcctctaacctgtctatcctttaaggttcagactcttgattctaacttgttatggctatgtatcttatttggaatctctaatgcttgaatctactgcttccagaaagctttcctggccttatcaatctaccctagagtctcctgcttctgagtttaggggtgggaacaggtgacaggcagtatatcaggacacaaggaggtctcaggggttaccctgtcactctgggtcgatgcttgggctgggtgctgtcagcttccctccctagttgctataagagtgccactgtgagtcttctcaaagtgtctcccgctttgctccctctcttttactgtcatgctcccttctaggatggacctggatccccagcccattggaataggctgttcccaagtttgggtaaacaccatgtccaagacacccttctccctttttgcagacatttcttctatatacatttctcaagggcccactgacctcttccaggctgatgatgtgtaacccaaagccttgagctcattctcactgggtcattcagtccatcctcccagaggactgcttcatcaattgctttgtttgtgcttttccccaggatctcagttggctttgagatgtttgactcatcgtcagtacttcccaatttcctcctgaaggtaccaaccatgtttgctaatttaaccatcagatatcccgtccgagttgctcatgagcatgagaaaacactaacgccttttttcccgtgggtggtatttgttggcttgtaaatctgaacaggaagagtacatttatttggagaaactatgaaatgcctacccttgaagagtgtttttgttgggggcagcaagagagtctgtatgcccataagtaccgggattcaggacttgagatcaggctagaggccagagataaggacctctttctaatctttgctgcaaatgaaaatggtcaataaatcagaactatttatggaatgcctaccatgttcagataacaggagaatgagaagttataaaaacaggcaaaaccatcttgactgaaaacttaacctaccacttgttggaggcctttgggactaaatctcacaggggtgcttgttgtctagaaattgagaacataatttagctcctgcttgagactgagaagtcctttgttatgtttattagatggggctgagttttaggatggcagaaatgcaaccttaactttctattcagcacctttaatgtatttctgctgaatacagaagacagttaatgtctctgaccccatttttttatttggagaaaagatctagcaatacctacctcaggctgtagttctgagaagtatattaagttcgttttcacactgctatgaagaagtacttgagactgggtaatttataaaggaaggaggtttaattgactcacagttccatgtggctggggaggcctcaggaaatcatggtggaaggcaaagggaagcaaggcatatcttacatggtggcaggatagagagagtgagggaaagtgccacacttttaaaccaccagatcttgtgagaactccctcactatcatgagaacagtgtgaggaaaaacactcccatgatccaatcacctcccaccaagttcttccctcgacatgtggggattacagttcaaggtgagatttgggtggggacgcagagacaaaccacatcaagaagtaaacaaaacattgtatgtcaggcactttgcaatgtacttggcacccaataggcaccaatgaacagacgatgctattgtagctggaccatcattgccggtgcctcctgggaagcagatgggaaacagtgttcatgttgtgtcctaccttgtcccatggaaaatcctgattttgagttctcttatctctcagattttatagtgttaagttagcacactgtagacagggtacatggaaaaatgtctggtgtccctgacacaagaaaagggacaaatctctctaagagagccatctggggtcttgtattgatgaaagcagtaaagaactgtggaaggagagaaaagctaagtgtctaaatgaagagtttgctacacacattctcaagggtgaagactggacaagacagactggcagaaggagaggagctaaggggtgatggtcccaggaaagaatggtgagcagcatcaagggtagtcaaagttgaaatagagaaggacaagccagttataaaatgagttgactggggcagcaaggctccaccttcttcccagtcagacatcagaacccatagcccagactctgcatgtatttaaagggactagaagacaatatggacccaaaagaggacagtctgcccatctttaggaaggagtcccctctcattttccttgtggatgctgtccatggaagtagacagccctcaactttcttcacagagcaaacttaccttcacctcagttgtgtgcctcacacttacatcagctcaaatagcatgaattctttaaaactacagaaattgttattgttacagcagtttgttcccaaggaacaaaggccacagcaggctggtattattttaatttttccatgacccatttatcaaaaataatgataagatttgaaatagatttcaacatggttaatgagatatttgcaatgcagtttatccgaagtggaagggcctagacatctaaactggttgtctggcaagattaaccttgtgtactttgccccatcttttgagagaaagatctctctaaatttcaaagaaaaaggcatcatttatttgcacctgaatggtacatttctgttcagaaaactgaaatcagctgcatacacagaacccggttgggacaacgtcaccactggggagagggtgagacaggccagatttatgaatacccaaggagggaataagcagatcaagatccatgtgggtacagaaggagatctaaatatgctacacttgtgaaaatttcatttgaataaggaatcaaattgcatcattttattttatttcttattttttagagatggggtattgctctgtcacccaggctggagtacagtggcctgatcatagctgactgcagcttcaaacatctgggtgcaattgttcctcctacctaagcctcccaagtagctggggctacaagtgtgtaccacaatgcctggctatttaaaagaaaaatttgtagagacctgggtcttgctctgttgcccctaggctggtcccaaactcctggcctcaagtgatgctccaccttggccttccaaagtgctgggattacaagtgtgagccaccccacccggccctactttatttattttttttttttttggagacggagtcttactctgttgcccaggctggagtgcagtggcacaatctcagctcactgcaacctctgcctcctgggttcaagtgattctcctgcctcagcttgccatgtagctgggattacaggctcgcaccaccacatctggctaatttttgtatttttagtagagacggggtttcaccgtgttggccaggctggtttcgagctcctgacctcaagtgagatgccctcctcagcctcccaaagtgctgggattacaggcatgagccaatgtacccggacccggccctacatctttttaatgttatgtctattctccttaagactgaagttctgtgtcttgctcttctggtgtatccaattagaagttgaagcaagagatgatcaattccatttaacaaaagaatagagaaaaatgtgtccgacacagcagttgctctcttaaaacaaagtgctatctcatgccttgccctgtagctttcataaaagtattttcaaagtctgcaaaaatgggcaggaaaaagtaatattctggaaaaagtgtatgaagtgggtaaggatgttggcctggtgggtctgggtatagagctaacactgtatagagtagaattttctaagttttaaagtttccccaattgccagagctcaagtatgtgttgtggattgcatttttccagattcaaagctattccctcctttaacattcccgctgtcttcttttcccccagtacgtgtattaatgacccaaacaagaaagacttcatgatggatggtgcttatttaattggccaaaatggaacgatgtgcactttcggaatccctttaattcttgagactaatctacatattggcaacttgtcataagaaatgggtagcaaacgctgaatcaaaactttttaggcttggcagcagtaaaatggcaatgtattaaatattctcttaggagactggagagtaaccattgtataagtgtaatgcagtcatggtaagataatggattaaatggcctcctttaggatattggctttgtatatctcatgtattaaaaaaaatactctttctgattttaatgtgtctctttaagcacacacaaaatggacaatggtcagtaatgagttactgcgttcaggatgaggggatgtttgcaacctgttctgtgcatccaaattccagcctgcctgtaggtttcctgctagagttcacaaggcttcatggctaaacttcctggtggggcttggaatgaaattttcccaggagaccacatggtgatttggaaccagaagagcttgtttacataagatcttctgcatgtaccagttgagagagattgggaaggccactgaaatttgtctctaagaaatatgaatgataatacttggtatttttctttcaaagagattgtgaggactggacaaagtggtggtttgaaaatatttcatatactgcaaagccttgcacaaatattgttattatgattataaaggctcttcctggtctgtaaaaaaaacattttcccaagtcctcccctatcttctatcagccatagtgaatccctgtctattcttagcatgtttgtgcgagggatatgtgaaagcgttggtgtcctcttgtccctctgttaaggactcagacaggatgccgggcacatttgtatccagacatcgttgagatgttttgaaatcggtctggtaagaaccaaagctatgtttccaattaattttctaagtacaaatatgctcaaagtacatttttttttaaaaaagaattcaacaataaagtatggcttgttgctgttcgactgccagaaactcgggatctctatgagtttcactgatatcaaaggcttctgtttaatataactttgtattaaagtgggccttactgtcaacctagcaaaacctcatgtttaatctcaagtttagtgtagtttttttattaatccaatgtgcatctgttaaaaataactccagataatgcaacatttgattaaatggaacttaatacagccattagctggtgggattttttttttccatttacgcattccaagctgagcctgataagatggcactaacatttagcctgaggtgtggaatgttaatagtgggatcttggacagtttgtttattttttatttatttcctgaatgtgccactcacagcaatgtgccagatgggcggcctggaaggcagaaattctctgtttagcctcggagccccaagaaactggcagattagcccccacccccagggcagccccagcttggtagaaaaaggcagaggggtaacattaaatcagagctgcagtatgtttttgttcttttgtcaaaggactgtgcaagtaacatgcttttcagggttggccatgcaaataacatgtcaagtgaaactttaccacctttttacttaggctatatagaaggaaggcctaaaaaatgccctggtcctcttgagcattttgagcccaggctgtcctggtggcaataggtttcctctgttgagaagtcctgcagctctggtgggttaggaccaccctccgcctggcactgagtgggtactctgtcacttcttggagccattaggctgaacagtagccagagaatacagaggccccattcattttgtcggtgcacatttattgggtagttactgtgtgctaggtaggatactaagccctgaagacagggcagtaaaaaagatagactcagtccctgccctcatggaactgacattctatctaacatctagctgctagttgaggatgctgcccatctctgctggtttgtaaaatttggtttctactctattaactgaatttcagctcactgaattagacttatgttccatggaccagttggtcttttgcaataattcttatactggtatttttagtgattttatgttagttttaatttcttcaagataaggattttggtttgatttgattcaacagttatttacaaacttcctattgtgtgtaagacttgacattcttcactactcccagcctctcccagggtgaagaggcaaaatgtacccccttccctcttgcctagcccatccaggaaggccgtcaagaaagggcaagttatataccacacgatgctgtcacatctaaaaggacactatccacatcacagagactgtaaatgtgtatttttatagtggtttcctgacagatgatgtgtcttgttctaagaaaatcattgtatgttaaggatattaagaaaatgtcccccatagcaaatgaaccttgaatcagattctttaaaaagaatcacattctttttaaaattagtataaagacactctgtaagccagtgggccccttgctcctttcctttcccttgtatcagggaccaggaccattcttctagttcattactgcaacagaggggaaaaatagtggagtcagagtggattccagttttaaccatgcaaatcaaccagctgtgtagcttcaagcacaacctataatcattttgagcttcaatttcctcatcagtaaaatggggattatccccatacctcatggagttgttaagaagatcaaatagagtaattctgggaatatgctctgctccatgtgcttgaactcaatggatgttatttcaatctggttgctggtatggggacagaggtaaggaagggaagtggggcatgaacctgccaagagacttgatgggagacagatcttacttctgtgtcctctgagtgactgggtgagttcgggggaccattttgtcctgggaaggctcatcactgaagacttgaaaacctctttcatttttagcaattcagagaaaggcattcaatttttttttattttcatcctggggattgcagtttacatgtgcaagaaaatgagggtgtcattctcctagttcccaggcacctaggctgattcattgcagcattaggagtggttaatggcaattgaagtagcagcagtttttggcagcaagcaggaccccaccagagaccctgggtaactcccaggtgttattgcaacctgtctggctttcgatggagctcactggttttcccatcaagctatctgccagtctcctgctttcatttcctgggcagagattcagaggtcagccggaaacccctttgcattgctgcagaggggctgatgcatccattgattctcatatttggttttgatcacagattgaaattagattgcttcctttcctggctgggattatgatagcactctgtagtttaagaaaatttattcactgtgcgttttgtttcttgaaaagccagataatttgtttctgtcctctactcaaagaaactcagtgaggactggccagactccaggagtaatgaggtgatggtgagaaaaacaccacccaaagacatgaatctttattagacccttcttgttgtgttggtggcaatattgcagtgcacaaggtgatgggtcttgatttccttctggcttgactggggtcggctagttccctcttgcggggcctttgtatcccagatggtggaatgtgtctaagtttggcaacccatattcacctgatggaataacacttccaaagtgtacatacaactgagaagatggagggggtttagcactcacgttctgggccatgtgtagatttgtgttttcattttcaagttgtcttcaagctcctctagggaggatgagtggatggaagggaatgttttatctgtatttgtagggagcttcctgagactccaaaggctggaatcctgtgactgaaacttgttacaaagaataaagtaatagagaggtgttcaaacccaagaggaggaggatggttcccaaaatttctcagttcttcataccctttgtttctcagtcattttttttcacaatgcctctaggcgaatgattgcatgtacacacacacacacacacacacacacacacacacagttctgtttattaagtagttagatcccaataagttaatttatgtcttaacagcttagtagccatttgaaaaaataggtatacattgaaagaaaatgtttttattaggccaggcgtggtgactcatgcctgtaatgccagcacttttggaagctgaggcgggtggatcacttgaggttgggagtttgagaccagcctgcccaagatggtgaaaccccatctctactaaaaatacaaaattagctgggcatggtggtgtgtgcctgtcatcccagctacttgggaggctgaggcaggagaatcgctttgacgctggagtcggaagtttcagtgagctaagattgtgcgactgcactccagcctgggtgacagagcgagattctgtctcaaaaaaaaaaaagtttttattcttaaataaccaaattagttaccagtgagatgtgtgtacctgttgggtactgcacagcatcacaaatcttggaatcaggttggacagtaccaccctgtttttgtgttccccactgattttcatgcagtacttgctttttatcacagcaaccactgaaatctcacttttgaaaagatatggcataatcagaaggaatgtagcatgatctaatgttgacactgagaactacattgacctactggtttgcagagtgacagatgtcatgtattgctgtattttccttgaaaatttaacatatttcaaaattaagttcaaattaatttaaatgtcccacagtgttcctatgtgtttgctgtggtgacccagggcccttcagcatacagctgggagcctagatcctgagcacaagatgctctcagataatccaaaacctggaggaaaggagtgcttgtctagtctcctgtccttatagtggctttcaggctcacctctgacccaccactaaaggaagatgcgccctgcacacagtgcatcaaattttatgattctagagggtgaagtgaaatctggctacgcaccgcaactagtagccctgcactgggttcctccttggtagccagctccaacaggtactgtgggacttgtttcttgtgctagcatagcctcgacctcaaggaagaagcaatcttggggagactgtcacaagctcaaggtggacaaagattctctgtctgaaggctcacaattcaaactggtcatttttgcagaatgcttctctttcctcggcacaaatgagagaaattgaactggattaagtaattaaacaatgattacatttaattaaattaggatttaaaaaaaaaatttccactcggatttttctaaagtggcatcattttcaagctgaacaagaatacgccctggaagtacaggaaaagacttctgtgcaaaattggcaacagaatccctaaatgcaagttctgggggtctagggattaaatgagaataatttaaatgggaaaaggccactttgcctccagtggaatgaaaacctttttcaaggtttacatttctgacaattttggtaaatcttcatgttttgatttgactgccagtgactggacattttcctttggaggcctagggcctgaacacattctgtcaagtttattatccaaggaggagattcctttcagtcccagatgggtgtgtggtagcaggtgggaattgccattgaaaagttgggagaccctaaatctcttttcatcagatctgaatgttggtggcaatatagaaatgcattgaagtgtttctaacaaagctgccctccctgcctagcattcagagggggaaagagggtattttgcaccatgacaacaggtgacctctatttggaattgtcaacaaacattaataggccttccaaaacacatacgctgtaatataagggattggttgcctgaagggagggccgggtattcagcagcactggggcagctcttacaggatgtcagcagacgtggttaattggtaatgattagggctgtctgcaagctgattccctaagtttggtgaacacataattgttgtatgtaaccccgagcggctttgctctttcatctatatgaagagatcagaaaagagagatttacggcttaggttgccccaagccacacatagcaggcttaattttcctttccaagggaatttgaagactgctgttgtgactagttctctgtggcttatatggtatgttgaggtcacctgcgagtttttgttaaatgattgattgactgaaattaattattctgtcagagctgtaatggcggtaagatggggtgcactgataaatacaaaagctaaagtgattcttataaatgcactatgtctctttctatttaaataaatcagacagaatacatagatcctggatggtgttgagtgtcccctccccattttcctctatagccctgagctgttttctttccaaatctgaagctttgaaatgagcggctatttactcaatttaactgcaggatatttgaatcctttgtcacttcattccttctaacctttccccaaacacctcagcccctgataagaggctgatgcccatgactgccttagattaaatcaactgaattgagagtctgtgtttgagctaatggctaggcaacttggggaatgtggctggtgagttggagagtggatagaaggcaggtgtttgcttctaaatgtcagatttctgaggcatggaaaccaccctgtagggcccttttaggagggcagtgaaagcagctgtttagtgacagactgtctgcagtttgggtccttaaatcccatgaagggattccagtggctggttaaggaaatgccaaaatgactctttcgattaccttgcaaagggcatgagattatttataagtgatgtatccaacttacttccaagtcactggaaacgatcgttagaaaaagccttttcccacacaggccctgatcatgacaaaggttccaggacatcttctgggagtggcaccaggttcaaaatgagcaagaacacatgggaggtacagaaaaagacttgtgggcaaattggccaagacagcagaataacaaacccaggtctcgcgtgcggtatgcctgtggggaaaacatctatggagtagggtcgtctagtcctttgtgtaagtgtgaaaaacttgttggcattggatagggtgatatgcttcccaagtctgttaccaacactcctaagttaaaagtaaacagcagtcacttgcttccttggttcttagattctagtgtgctcttttagaatattctagagtgcttgttaaatatgcagattcctgggaaccacctccagtgagtctaatttcttagatatgacacagagcttgggactcttcattttcttcagtaagttccatggtgattttggtgcagattgtcccaactgtccagttctttatttaacaattgatcagaccaggggccaagagaagaaactacagctgttccatttgacaaaaatagccctccaaaaggcctgcgactagtcaacatgcagatggaacttcttgagtttgagtaattttacgcatcttaagatcagccctggctatttcaatgccaatcatcttgaggtataccagctattgaatgcatggctccctgaatatctcagaaaatgaaatggttaaaataggaggggtattgaaaattgctgtttcttgttgatagttaaaatttcattggctggatgtgatttaagcagcaacataagattcatttaaactgtcataaattaagacatcctattatggagggaaattttttagaaatctttcccagcaatttctaaaaagagtaggactaacttggaactctttgtagtcattcctgctaaaggtaagaatgggcgtgctctctctagtctattaccctgtgatttagttaggtagagctcagacttgcactgctccgaacaatgtgttgtgaagttaaattgaaggcctgaaaaggtatgcatatatcccactactttatgaactctgtgactcataatgccttacaatatatttgaaagcaaattaaagactttataaaatgtttttaagtatgcccctcctcttttaaaacatttatggcttctataaatgctatataaaatgctttggagagtggtcatcgctggactaaggctaggttgcataaatatttagttagagatatgagcgtgtttcttgaagctgtacatgtgtcggagtttccttgctgttcctgcaaagtcaggcctgttagcaatgtgatggaagataaaggaagcggggagccaagatggaaatgcatatttgccatcgcaggggatagtgctccattaaagtatcactgtttttgtttctgtacttaaaaaatttaaacatgtctttgattgcagactgttttcattgtgtcattttaaataataattaggctccctgcttcaatcattctcttttaaagtgatttcggaagtccatgactggaaagatccggtatttaaaggaaaggcacctctgaggctaacaactggtggtgtcatttgaccaagaactttcccagaaaattcatctggggatccttaggctcttttagaatattgagttttgttttattgttatttttaatcccaaatacaccagatgttattattatcgcatatctctgggaagagaagaagctaagatgaatgtgcccttattttttatgtacttctagtagctgtgcaatcttcaatgacagtgaacagaatatatgcccatgaaactgaccagaaaacaaaaatgtgttgctgtctgcaatgtgccagtcactgtgataggcagtgagcttcaaaaatgagtaaagcatggccctagggagtcagagatccaagcagaaaattatagtaaaatgtgataaaatgtgtataaggagaggcctgcagcaggagaagctaattctaactggagctttcaggagaaatgatgactgtaaagtgaggaggtagaatctgtgtattcattatttagcttgaaagcactaacttgcgtcaacccatacttgatattttgatggtggacaaataatggcatttattcaggcagggagtagagccagtgcaaaggtacagagacttgaagggacaggatatagcagaaaattagtggtgtgcagtattgcttgagcaacatttgcaaggaggttggggttaccactgggctaagaggtatacagggactagagtatgaagaattttgagtctgttgcagaagtgcttagatttggcctgtttgtagtaggggaaccactgagttatttcggatggacaagaacaggataagatttgtgttttgagaaaaagtttttggaatcaggagcatctcaattgcatcccatgcccttggaaaatggaagggaaaatctgaggctcctaacacttctttcctgacatctgcttccattatttttttgtcatggggcagtcagggatgcctgggctctaacactgtttgggtatccgggtacacaaggtaggatgaagagagaaaggaatgaagagtagaaaaatgaacataatagaattatgagcttgaatctcacataggctcacatgtccaggcattattttgctgctttgataatacttgtggcacacatgggaatcctgaaaggtgcaaagtctcatgttggatctgtaagatgtagcttcttagcttatgaggcagttggaaaacgttaggctttgttctctccagtgcttaagttattcactggaagtgctctagctaccatatcaacctgtctctgcagacagaccatgggtcagacacttggatggaaagtccaatatgtgcttgatgatccagaaaggagttatatgaaaaaggaattttttatcaaaaggccacaaaatactctatcaaacaaagtcaagcaagcttcctttctttgcagcttctcaagcctttaatgttccaaagtacaatatgaatctccaagacaatgatggaatgtgtcctaattttatataatttcctaaaattatttgtgaaaacttatttttttctacaaagcatcttgtgaaacttgtgtttcctgggatgctctttggtcaaagccactcttgagattcatttttacaggcctcctaattgtacattgaatggaattcccttcatcaaaagttgtgcctactcagttcctaaaatgccagagggagtgaaaaccagaccattcagcaaaaacaaaaggtgccccctactaataatttgacatcatgttggtgaaacaaaggcttgcattcctcccattctaactggttgcttttgcaaagacacaacttccggttctggtgggcagaatggggtctgttgggaaggttccagcaaaaggcaactcttcttgaccttgtaccattgaaagtcacagagctattaaagtagcgaccagggcattcagaagagctgtgactaggcataatgtgccttttgagggtgaccattcatttgtccatctaattagcactcagcacctttgattgccccatacatctttaaaaaattcaaataggtagtgaaaactgcttggattgcagggctcagatgaaaattgaggcctggccttgtatttatggaggtttcttctttccaggacgtcttacctgtttccttagccctgttctcagtaatgcctgccacaaagaaccccataaatttagcatttgcagctataagtttgtcattcttttcttgaaataagataagggtactattataaaacagcagaaggctgaatgtgagagcagccgacatattgttgactgattcatctggggcatttagttcttcaaaatggaaaaacaaaatagggtctaaaaagcaaacacagtaaattaaaggaatgttattctatgcatagaacagctgttttaatacttgcttggtagggtcatgtgactgacccacttcttttaggataaaatatgtcttcctctaaggttattattaaagacacatggagacatttactttggtctccttgtcagcattgtgccacattacaagaaaatacaaaacaccatttaaattgggtttagatccttcatttgcatgaaaacgatagttaattgtgtccctgtgatgataattagtgttcagctaagaggaccttttcattgttggcccgaggtgaggcctgagttactaagaattgtactggtggtagctgttttcttttaagtaactgcacagctctgtctgttttgccaactggcaaaatgaattaacaggaagtgaaacatttagtgtttacatgagctaggacattgttacccaacacaaggagaaagctcactttgggccttctttggttatgggatgcttattgtctaatttcttcagcaaacatggagtacctactcaatattaggacctggtgtgccctgcacaattagaagctctcagagagcagggactccacagtagcataattgaaatctctgttcactttgaatcctgaactagaaatgttctcacccacctgaggcttgaccatgttttcagagctgccacgtggcaggaaaagagtccaaatctgctccttctgcagtgatctctccctgtgctacttccttacactgctttgctctgtaccagccattcaggaagatttatcaagtggctagttattatagaacaggacagaatactgggccagatcccccctccatcccacttaactgtgccttaatcattaagtgttctccagttgacctctctgtgaactcctaaaaggtcaagaccaattctgtttcaccttagaacatgcaattctgtagtgcattacatgcatgcaattgcattatatccaacgtgtaataaatatgtgctgaatgcatgaatgagagaatgaatgaatgatcttgccgtatttcaacttagcacagggtccattctctacctttgtgacatctagctacatcttgcgttgtcttctggtggtagggtcctggctaccttatggtgcaacccttttctctatgggcaactctgactgtaaaatggtcctttctctttttaatatccagtcagctgtaacatcacggggtctacctcctgaagccatgtggagtttggtctgattcctctttcacataattcttcagctattggaagacacctggtatatgtttctcatctccatatttaacataacagtttcctcagttggtcctcatatgacatggttccccaatacatctctatctttaatgctttcatatcaacatagtaatttaaccagtggtttaaaaaaattattttattttgttttaatgagcgtggagccagaactgagcatagtatttcatgaaggaatgatcagggcagaatagatacagatcattgccttcctccatctgaccttctgcttatactatttttataattggggactgtacaattcattattttattgcatttcattttcagcagtcatgccattgaattgattcatacaaactagcggttatctaaaccagtggttctcaagtgggggtgatttttatctccctggagacagttggcaatgtttggagaccttattgattttcagtactggcggttggttgtgacactaatatttagtgggtagaagccgtggatatggctaaacatcctacaatgcacagggcagcccttccacaataaagaattagctgtttaaaatgttagtagtggccgggtgcattggttcacacctgtaatcttaacactttgggaggccaaggaaggcggatcacttgaagtcaggagtttgagacccgcctggtcaatatagtgaaaccccatctctactaaaaaatacaaaaattagccgggcatgatgacatgcacctgtaatcccagctactcgggagtctgaggcagaagaatcgcttgaacccaggaggcagaggctgcggtgagtcgagatcgcgccaccacactccagcctgggcaacagagagatactccatttcaaaaaaaaaaaaaattgttagtagttccactgctgagaaattctggtctaaactacacagtctttgtccttggggcctcctgaagtagaccttgatcccaggctacatgagatcttgcaaatctttaaaagtgattcagtaggaccatgtccttgtaggtgaagcttttccaggccctctgtcaaccatttcttccaagacttctactttcttaactttctggtcacccaccttgcagttagagcagtgctcctgggatggaatgctttggttgtcatctgaagcctaggacagtgcttctcaaactttactgtgcctagaaaccacctggagattttgttaaaatcacattctgattcagtgggtctagggtggaggaagactgcatttctaaaaagctcacaggtggtgcctggggcagaaggccagtgggccgcactttgaggaggaagagtcttagcatgttttctcttggcattgtttggacaaaggctttttccattcccttggagcagagtgcaagcctcttatgctgggaacctttgactgtcacactcagccctggccatgtgtcaggacagagtagttgagcaccatgatgttataatgctgaagaagactaatggcctgcttaattgctgagcagtgtttataacttacaggtctttgcatcgccctattctaggttaaggagaaacaataacaaagcgatattactctcctaattgaaagttggagggtggaatgaaggaggagctgcccccagtcacagacttggaggaatgaactatccagttgtgagctggtttctccagattatgcatatgtttataaattatcctaggtgttctttttcctcattccttttattgtagagtgtatttctttaaagtgacaggttttatttttttccccactctgtgcagatttcgaggatgatgtagcttaataaatcaaactgatttctactattgtatgaagactccttaatcagttctttgaattaatgcaatcaaatggttgaattcttacattcatctctgtatttatggctctgttgtgcttttttattgaattggaagaggaatatcttcattcacagccaaaataaaataaatctaggcaggttatctagtaaaatgactaaggtatagggtatgggatgtgtatgtgtgtgtgcacttgtgtgtgaatgtgtgcctaaaaatacagatgtcatctgtgtcgttctaatattaaattttgttttggaacttcatattcatgaagccagcattatgtcaaactctgtgataatggtcctgtttttaccaggtcatgaatccaggggttctcaaacatgttcaagaagcagggcatttgaaaattatggtgtttcttgagtgataccatggatttcatatgccccggtttaagggcacaggctctagagttaggcaacctagaggaattcccgtttcctccatggactggctatgtgaccttgttacttaacttctctattcctcctttcccttatccttaaagtagggataatactgaagtgtctatcttgcagaaccatgctgaggcttagaaccacaggcatttacttgtatccttgacacccatgcagcaagtatgtgctacgtggagaccattattagtattaacccaaacttaaaacggctaaatatagcattttctgccaaatcagaaatgctatcttatggcacattctctcagagacaatagtcacaggcactgaggatgtaagaaaaatgattagaggacaataataaaattgaaatagtgctatcctttaacaaattgggaagctatctccattattgagttttaatccaggatcttggcagacacaggagtttggctgagagagtttgtgcattagccctaccctgctttttcacgtgctctgaagcatcctgaatctacaacatgtgatgcacattgaaacctctttctttctgattttacaatatcagtatggtacaccgatcaattaaaaatactttgtaaacatatgtggagtaagactccacttcaaaaaaaatttttttgagacagagtgtcactctgtcacccaggctggagtgcagtggcacaatcttgccttactgcagccttgacctcccaggctcaagtgatcctcctgcctcagcctcccaagtagctgggactataggcgtgtgccaccaagcctggctaatttttttttatttttagtagagatgatgtttcatgatgtttcccaggctggtcttgaactcctgaactgaagcaatcctcctgcctctgcctactcaagtgctgggatgacaggcatgagccactgcatccagcttagacctcatttttaaaatatggcaggcatacatctgaatgtatgcatgtttaatggagctaatgatagaaacgttagagagtgattattctaattactaaacaattcacaggatttcttaccacagcaaatgcctttcatgtctactttttgccagtttataatatggttcacaaacataaaagttctctgtcttaaaattctgatgccattcatcgatctagttggatgagtttttattacttgcataagaggggattggggtgggatggtcatatgggtttgtaggcatctacaaacagcatgctgtaaagtcttatttcttgagttttcaccagtagcaatagtcttattgctaatcgacttcatcataaaaattgtacttgatattggatagcatgccacatattaccaaccactttcacgtgtatattttttctttttctttttcttttttttttttttctttctgagacagggcttagctcttgttgctcaggctggagtgcagtggcacaatctcggctcactgcagcgcctgcctcccaggttcaagctattctcctgcctcagcctcctgagtagctgggattacaggtgcctgccaccacgcccagctaatttttgtatttcagtagagatggggtttcgccatgttggccaggctggtctcaaattcctgacctcaggtgatctgcctgccttggcctcccaaagtgctgggattacaggcgtgagccaccatgcctggccaattttttttatttcgtaacgcttagtgaccccatattattagtattattatttttatttatttatttatttatttatttatttatttatttatatttagacggagtttcgctcttgctgcccaggctggagtgcaatagtgtgatctcggctccccgtaacctctacctcctgggtacaagcgattctcctgcctcagcctcccaagtagctgggattacaggcatgcaccaccacgccagctaactttgtatttttagtagagatggagtttcaccatattgtctgggctggtctcaaactcttgacctcatgatccgcctgtcttggcctcccaaagtgcagggattacaggcgtgagccccacgcccggagtggccctatattattattgaagaaagatacagagagctgaaatgatttgtcgaatgtcacatgacttgtaagcaccagagctaggtctcataccaagttctgcttcttccaaatccgttgtccagcttgttgggtatgtctgagtccctgttagccacaatgccataattgttatagtgttcttagagtagagctcagagcctattatgttgcatctgtatctcatcctcacctcttcttttgttggatacatttttcatgatttgctgaggatattgtggacttagtgtcaaatatttttcaggtcagaagttttgtagcccttggaaatcaaccaataacctatgtaaaactggtgccgatgtttctgctgagagcttcagaactgctatatcaattagcttttgctgggtaaaaaactactccccacaattagtgacttaaaacagcaaatatttctttagttcccagttgtgcagattggcagtttggactcggttggatggttctttgcaatcagagcggtcctggctcttcttggctggtctttctcacaggtctttggtctcagctggggaccctaggatggcttatatggctggggtctctcttcatgtggcctttcctttttcagcaggttagtctcagtgttgttcacatggtggcttcagagttccatgagcagcaaagaacaagccccgtacctttcaagtctgattctgtcacgttggctacttttttattgctcaaagctagttatgtggccaagcccagagtcaacataagaagggattgttttggcgagaaatcaccagggacacagatacagggagatctgaacaaattgagagccattaccgcaacagtctgttacactgccacatcaagttttcctttccttccaaactttttgagtgaagttctaatgccctgaaaacccaggagatactttctcttcactgaggcatttccttccctgacttcctccatgggacagcttggcattaatgaattgaaagattgtccttagtcagggcttttctgacttcttaatggtgtgcatgtaacttctccttgtcaggtttccctttagaaatgcatgcatttatttggaatccggatgctggagttttctgtttggaaaagaattttaatgaaactttatcaggtgtgtgttcaccaaaatgaagaggactcttttgtgtccagagaaagctatctggcagtcaggagccctttagaaaaaggactgcagaatgaaggaaagctaaacctctctttaatgattttctctttttaaaacatattactttgcatgaaaatttgtgtcaaggagtttagctcatggaaggggaacttgatgtgcaatctggaggaaggagcggacactagatgataattctcaagcagatgaaagagaatatttcacattgctgagacacatgtgacttctttggatgcaaataacagaaaggttgatgacagttatccctgttccctgctctgcggagaaatcaccagcttagcaacactaaatggcaaggcatttgtggctgagttctttctctgactaattggaaacacatctctctattttcctgccattgagaaagagctactctttggtaaatggtattcagtggtttacttttctaaaaactcagccctgtgctgagcttttggtcagaagaatggaaatgctttctaatgccagagagcatgagtactttttgtggagacagtgggatccattagaaagtgactggacattttggagtcccaacttggtagaatctcacaagttctgctccctgtgagttcaacaacttgaacaaatcccttctcttctctggcctcagcttcttcacttgtaaaatgagaagaatggagcaaataatttcaaagggtttaaaaaaaatgtttttgaatagagactgcgtctcactcactgtgttgcccaggctgctctcaacctcctgggctcaagtgatcctcctgccttggtctcccgaagtgctaggattacaggcatgagccactgtccctggcccaaagtattttttaatctctgtcaggtcagactataatttggaaaaatatatatttaatttttggttataaatttaggattttgagatttggtgattcggagaagacattgtgaaatacttactgggtttatggcagaggacactttgtaaaacaaaacaaagcaaatctctattcttgccctgatagggattgtgccacccatctctccatgtgcccgtccacccatctctattccatgtgcccgtccacccatctctattccatgtacttgtccacccatctctccatgtgcctgtccacccatctctattccatgtgcccatctacccatctctatttcatgtgcccatccacccatctctatttcatgtgcccatccacccatctctccatgtgtctgtccacccatttctccatgttcccatccacccatctctatctcatgtggccatctacccatctctccatgtgcccgtccacccatccctattccatgtgcccatctacccatctctattccatgtgcccatcccacccatctctattccatgtgcccatccacccatctctatttcatgtgcctgtccacccatctctattccatgtgcctgtccacccgtctctattccatgtgcctgtccacccatctctattttatgtatccatcaacccatctctccatgtgcccgtccacccatctctattccatgtgcccatccacccatctctccatgtgcccatctacccatctctattccatgtgcctgtccacccatctctattccatgtgcccgtccacccatctctattccatgtgcccatccacccatctttatttcatgtgcctgtccacccatctctattccatgtgcccatccacccatctctccatgtgcccatccacccatctctattccatgtgcccatctacccatctctattccatatgcctgtccactcatctctccatgtgcccattcacccacatatccactaccttcttattttcttcatttgttccagacattagtgttaaggtgcttaacttctttaatttatccagctcttgcagggaaacaagacacagtttttaaatagcaaatgaggaaagtgaggccacaaggttatatcatttacccaatgtcctcagatggtataggggaaaattacgactaatccccaattgtaggtccagggctctttccctaagatacaacacttcttttgtgcctcttctaaaatgtcctagaaaagccagaacctgacatctgtttcttaagtttggggtggcccaaggtcccaatctagggcttaattgttgaatgagaaagaaatagggttatttcctttccggaagaatgttatttgagctgccatcctccaccataaatgaagatggtaggtttttgagcactctgtggctagaagaatgatgaacattatgagagatccagaaaaatcaggagaatccctggcttctggagtttactggcagagtctgatatgacagtgacatactcatgacatcacccatgacagtgatatatttgacaaatgagggccccacataataagtagtcattttcatagtacttaagaaaagggagacagaggcccctagcaaccgtgggatcctctaactgccagaggtagtagaggatgcctaggtcccaagagcgcacttaaaaaagagaggaaaagccacttcttcctaagtaactttctctggaaagctgtgatgtccctccagaggggcttaggacagaggttgttggacccggaagagcatatttcacctaaatcttggggtgaaaacacagaccagatggggtgcctcttctgtgtctctccatataaagaaggatatatcctgggtttcgaggtggattcaattcttaaaacagaccccatcatccaccccaggcaattttgtttgatcccaagttcagtaatgtgaagtaaagtttcccagactttaatggcttaaaatgaaagagaatcatgtttttctgtctgaaactggaaatccaaagagttgctcagtgagaatgttcagacttctaccttgaggctcagctacaggaaattgggaaatttgggtcagatgtctcattcacattccaaattgataaagggtgggaacgtttggagaattgtctgaatcataatgctactgagaaagttagaaaatataggattattattccctaaattacttttctttgtgggggtgcggggtgaaggggaggaggttgaggagaaattgtcagtatgctctagatggcagagagtggtgtttcatttagctattccagtgggtggattgtaccagtgtagagatgctgggccttcctgttgtgaagtaactcttgggggaagttggctggtggtaggatatgcagatctttgctactgaaaatggggtctttgggccagcaacattggcatcaccagggagcctgtcagaaatgcagaatcgttgaggccaccatcccagacctactgaattagcatccaccttttaacaaaacctcccagtgacccatacgcatgggaaactcgagaagcattggcctagataatcatccactgggacgatgaaaggcacacatcctctccttcctcccgtcgatcaaaagacgcatctggattggtttcttgattttgtcgatgatgacctaagagaaagggagtttaacctccaggagctgaactcagcagtgggactgtgctgcctcatctccagctactaaccgttctatccaccctgaccctctcactgttctcagaacaggttggaacctcttacgacgttgtgcttgtcccactgcctggaatgctttttctctctttcctcacacatcaaactcctgtcacctttcataagcttgctcacatggcatcttttctgggaaacattcctcattttccccaggtaggattaggtactgtaccttctgtttacttatgcctctaataaattacagtagtacaggaaagtatgcatgtctgttttcctttctggactgggaactcctggaggatcttacaccccttgtgatcacctctgtgtcctcagcccctaacacagagcaggcatgtaatccatatctgttgcatggctgcatgaaaatacaggtgaactggctgtgaatgccttttgtgggactctgggaagttctcgttcttccaggcagctgtgtgggctgtgttaatcataaatttctggatccatgaggctcccaagttaaagactgggtcagcactgagcaaaattgtcaagggagatgggactatccagtaaccactttcccctctcatgcctggcatacctccgattgccccagactttcatgcagcccctgcactgaggttggttccctgtggctaaattccacccctcccaaatcagagcctacctatctccttaaagagtcagtgcccatttgtccggggcttgctatgcgccaaacgctctacagaaactgctttgtgcacatcatcgcattcagtggccacaacaattctgtaaacataggcgtcatcatttccatttcatatggaggaaactgcagtttgtggtggttaagtaatttgctcacagcaaggtggtcaggcagagctgggattcaaactcaagcctgtctgacttactaattggcactttgaaatgctactctgtgccacaacaggggtaatgaatcagccggggaaacccatgaaggtgctaacctaccattgtacataattgatcaaaacacttgctctgaacagtgagctgttttagatacactttaccagggggaagagaataattacaagtgaccgcagtagatgcctctatctggtcgattctgactttctcaagctctgactagcctttaagacattctgtttctaagactgaggaccactgccacaagtctcagctagttcagggatcctacgtctgtgaagccctgggaagggggctgggagtgtgagctgccattttgcctttaactttgtcctgttagttgagaaacatgccacattattactgacttaagtatttatttttggttgggggatggggtgattttttaaaaaacaatgcccagtgtgtgtgacttctgcacatagtcatgtgagtcacttcctgtttagtggaagccctctttatccacccctacctatccaatgggatcatctcgccttttccacctcctctgtcccctccataaaatatgctcactggtggtcgggtgtggtggctcatgcctgtaatcccagcactttgggaggccaaggcaggcagctcacctgaggtcaggagatcgagaccagcctggccatcatggtggaacctcatttctactaaaaacacaaaagttagctgggcgtggtggcacatacctgtaatcccagctacttggaagcctgagacaggagaatcacttgaacccgggaggcagaggttgcagtgagccgagatcaggccactgcactccagcatgggtgacagaacgagactccatctcaaaaaaaaaagtatgtccactggtgttcctgttcccagtgagaaggcacctccctctagaccttccatactcagctgctctcaccaagatgcagttacgtttattcccaaacttgtttatgccagtttttcttgtacaagattggtaaacatagttcaattaaatattatataaaccaacgaactatgggtacaagactaaagagctgtcattttatgatcactgagttaaatgctttggaaaaatttcataaagcaaatgttaccgagtttttttaaaaaaaggaagccaacaaattatatgagagcaggccaagagagcttaaaacaagaaaggcagaactttatcatctaaagtagcctgtgctcagtttgcctttcaagggtctttatactctgctccattttaaagaaaccctaaactggaaattggcggggggcaacagtttatgagtattttgggataaaaactatgaagtgggactaatcacagggcagccagcaaggaaacatggacctcaatcccggagcccagtggaactgaattctaccagcaacctgactggggctaagaagggacagattctaccccagagcctggtccagccagcaacttgattttggccttgtcagactcaatgcggggaaaccagctgtgcccactggcttttgaccttcagaaataggaggaaacacatgtgcattgcattcagcagtgaagcccagggtaatctgttagagcagccatggaaaaccaacccagcaagcatgtcctcccctctgcttgtgcctatccagaccaccaatcccatatttttcccaggccctttcaccacactctgctcagtatggctttccaggccctcggcactggtgttgcctcagctttgcttttaaaacttgcctttccgctgggtgcggtggctcacacttgtaatcctagcactttgggaggccgaggagggcggatcacctgaggtcaggagttcaagaccagcctggccaatgtggtgaaaccttgtctctactaaaaatacaaaaatcagccaggtgtggtggtgggcacctataattccagctacgcagcaggctgaagcaggagaatcacttgaacccaggaggcagaggctacagtgagctgagatcacacccactgcactccagcctaggcaacaagagtgaaactccatctgaaaaataaatgaataaaataaaaaaaaacttgcctttcacacaaactgtctcccctaataagctaaggagagtcactctcacctaaaaacagactgtgcttccgtgcctctgagcatttgctcagtcctgttcccctcctcacagcctcctagatacatctgactcatctttccaggcccagctgagacccaggcttccctatgcaggtcgcctccttgtgtgactgctgtggcctgctgagaacttgctgctcatgtttccctctgggccttcgtcttctgttgggggtgttttcttctctctctggattgacggcataagaattagtatattgtacgtgatccatggctcctgtgagggactggatgttaccatgatccatacaaacacctgcagagctcttttgtatgtagtggttgatttctggggtccttgctttgagttatctctccttcaatatcaagataaggatttgatctcttctaaagtgtcttgtaaatgacttctttaaatgatttttgttccaaagaagggtgtctctctgaacatggagccagcccctcggatttgtggctgcttccattgctgatgtatcacgtacaatcctgtatgaacatccattgtgtgtactctgagagagtgtcctatagcaccagcacatggggacactatccagggagagatggcaggatgctggggtggggagtaggagccagggaatattttgaaagcatttgacttattttccactgtagctatctattcttcattccatgctaatgggataatttgatcaatgaatgaactgggaaaaggcaggagatgcataaaaagtgtaaaagcgcatagctacaaatgagtgggcagatttaccaccttctccccagaatcagatctgtctgccatccgcaccgggaatgagacaggcagatccgagctttggcttaattacacataatttgggtgacagctgaaatgcaaacctaaacattcaatcagttaaaaatacacaaaattaagcatttcacacagtgtccaaccccttcaatctttattaatactttaattatgttaattataccatggtttcaagccctgctactacaacaagcagggggtggaggtggggaagaggcagtcctcgagctaaataatgattgcattcgaattaaaagtaggaatggaatgcaaagtagcaaagaatcacaaatacataattcagcagtttacccaccctgttcacacttctttttttcctgcctggcagtgtttctgaagggtgggtccaagtctgactcatcctctgagtgtactgtacatagtaagtgctcagtaaacatctgttgaattaatttttcatcaaggatgctgaaattgtatccatagatataaaaagatgtgagcagatgtttgggatatatatattgaaatggcggtggccaatattatggctgacagttatttgtgggttagtgggaacagtggtggtgcagggggtaggggcgagaggaagaaagagaggaacagaaaatgaccaggattgcagagattcatcacccttctatgaagtcacttgatttctttggactcagtttctccgcatctctaacaaatgaggaggaggagattagaccttaatggttatcaaactttgttctcctggattcctcaaaggaacatcagggactccactgcgtatgtgtgttggagggacatctggaggataaggttctgctttaatttatttattggatgtctaagagttttattctaaaagttgcttaaaaatggtttggaaacttctgcatgtgatagcctttttaacctctaactcacccactcacagacagtctcctgtgctctggttggagggtttccattggtccaacacttcacctgtcttgtcctttgtcctgggtatgtgggtcccccttactcatctgcttttctagcccccatgtgattttacttttcaccttccatgtctttgctcatcttgggctgaaatgtccttcctctctgtctgcacctatcaacatcctacagttcactaagcctggtacccagttgcctcctctggaaagacttcctggactgcacttgtcattggtgctctctcctctttccagattcctttgattcacagtgcctgactcacattcctcctttttttcatatgtgctagtcttgtcttattgactagataatcaatttctcaaatgagaaacattcagccttctcttgagtctttcttccactctgccttagactggacacataggtgactactcaagaagtcttactacacatccaatagcatttgacagggagttagccacataaaatccaatgagcctctagccagagagaattcagttgctgaaactacaacaatgaatgactgtactttagattttttactttatagtttgctgagctgaaaccaaaatgtcacttgggtgacttgcacaagataggtttttaggttttgctaggctgacatgtacagaatcatcagttgttgggagtgtctttttaatatcaacagagaaaaccttgaagattcataaatctgaaatagaaatgcagtgtttgcttcaaagagcaattccttagtttgttgttggtgagaactggctctgtgactgtaccttttgcccaagtatccttagctaagctaaatgtcttcagagtctcacaaatagttctcatattctgtggttatcactactgagattctccctggtgcacagaattgacattggagctctccatgtagtttttggtggccggctcaagttgctgtctcatcactccttaactctacatcctacaagtcaccaatgtgggggcaaaggttcaaaaaggaaccaattcactagcttcttggttcagcaacaagactctcagcatcacagaatcttatagattatcaaaaggaaacatagcccaagtccattaacctacaaatgttgactattatttaaaaccaaactttattacaatggagaatacagaattaacataggatacagattttgcactacagatttttctttttgtatggtgtgaaaattaaaacacacacacacacacacacacacacacacataaaaaaaaaaaactatagagaaatataaaaaatgaccaagtgctaactatggttcccaggtactatgagaatttggaaagaagaaaaatcattatggaaaagtagaaacagctaagttgttgggtccatttttcacactcaaaagattttttttctaattattgcttctactcctgggcctcccttttttttggaaggaagtgtctgccaaggtacatctgctgaacaataattcattcacaccccaataaaagtatgaatattaccaatcagccctcttgcaaacaagaaagagataaccggatgtccacactgaactaatgataatttcagccaaaaggcaaagaagcttcatgtttttatcagcctttgtatcttattgcaagtggatgcattatttgttgtcatttgttggtttcagatattgaaattagctttcagaaaatctgtgtactacattgtggggaccactaagaatcttccacatggattgggaatcctgtgccaaggagtttgctcataatcatggaagaagatcaagatcagtgtaggtggaagtgacttggatcttgcaataactagggcttggtcaagcaatgtgggggtggggggatgtgccaaggaatcaggcaatgtccataaattcagtcccttttgtgcaccattgctgactgttccaaggccacacatctgacttcccattcctcctaattttgtgagctcgtactccatgagtgggagaagatggatcaccattttgtgaactgtgctgttttgcatctcaccccaaaaacgcatcccaaattgagcatatgtgatcttcagtaacattcaggaatttcccatcacttgaagtctttagttacagccacaccttttaaaaacaaaatagatgattttgaggatgtcattggctaatttgcagacctgctttgcattggcatctagaccagtgttcgttactggaggcacatctctctgtcgggtgattcagactgtatatgagattggggggtgtaccttgaccacatcaagttgtgaatggaagatgctgccttggtaattttacccaagaccctggttgtatccatttaataaaattagaacatgtatcatttgagaagggaaagtaattatctctgttagttgtaatctcctcaaattcaaatgcatgacatagagatttctcttcaatggcacagttatagacttggtggttaattaaacatcttttctaatcaaattagctttcatttcctaagtggaggtttttaacctggaagtggctttgaaacattgtttctttcagccatcacctatgaaaggaaagataatgtcccttcaaaggactcctctaacagtgaataattattctttgtttgactgcaaatgcacattcttgaaataatatattcgtaaagtttcataaattatttcaagacatattaaagagcattggaaatagttctactccctccaggaggttgccaagaaaaagttttgtcctttaaaatttgaaacaaattattattcactggggggacatcattggagcttcccctagctccagctgacaggaacaatttgagctaacctgttaatggtaatgcttttaaaatttagagatactcttaagtggagcaatttttaaaaattaaaactatagctagggggaattgcctttggaggtcatgcaatgttagggacactgcacatctacctggatcagggcctggattccagctgcctgggttgcatgttacatcatggcccatggaggtgagggagacaggagtgtctctggttgaatttcaactaaatgctcccaggcataattctcctgagacttgcagcttggctataaaatacagcataatatagcacaaaagctactgtaattggggttgggaaaacggagttccagtcccagaagtcacataacgttgtaaaaaatccactattttctcatctgcacaatgaaagaattggcttaaataatctcccatatcccttctaactccaacattttgtgcttttactgtaagatgtcacttgaaccaaatttttttttttttttttttttttttatgagacggagtctcctctgtcgcccaggccggactgcgtccgcagtggcgcaatctcggctcactgtaagctccgcttcccaggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccacctcggcctcccaaagtgctgggattacaggtgtgagccaccgcgcccggccgcaacatcatttcttaatagctcattttgtagcttacctggtaagtgataactacatttctgaagacttattgactagatagttatggcatggaacaagccttatatcctcatctgaactgaaatctctgaggaaaacaagaaaacaagaaagcaaaggagaccagcacttgcttgggcactcacaatgtggcaggagctgtacttggtgattttggggcttttgttttctgctattggagttgaatgaagtgctgggaacagcagaactctccataaattctgcctggattaaatgcaaccacctgccacataactaatggggcccaagtttagaaagaaaatcagtttctttgcagctgttcttacaacctgcctgttgttcttcagaaaccaaattccgaaatatcatctcacaggcagttaaaatgctaaatgaggagcactgggttgagaatggtgtagtaaggtgatggttgggggatgtcagcaggactcaaagacctgggcctcagctgtttctctcatcagtttgctattttacacattgacttgagcatggacgagagtgttcaggagcaaataccttttaggtagcagactgagcatgtgcaggtttgactcttcttgtgctcctaggacagagcaagtttcattttgagggatgggaggaggtgtaccttgctgtatctgagatggcaaatgcaaggcacgtgttcagctatccccatatctggcagacattgctaatctatgatggctctctttctgagctccaatagcctcagaatcctttcaacagagctttctggacagccattatcaaatggcaggtgttggcacaggagatgaagtctgtttgtcaagatttgggctaagtagtagattctttcttgaaaaaaaaaaaagtgtgcatccgtcacatttgtgggtaatccaaagcccttttttagtttaagtgcaggacaggacttgactttatagaaggacacagtggggatcatttttcttctacatctgaagttatccatgtcccaattctacttaaccacgttgttcttgaaaaaagagaaattgggaggaatttcttgtgaattgatctgtagttgcctgatttataaaatgggtgtaagtgagaatagattgataaaatgtggtggataccatggactatctacagtgactagaatcagcaaagcagaggtttatatcacagcacaatgaatctcagaaataggggactggatgaaagaagaaagaggatgacacaataacaatatgacttgcataaatttaaaatgtacaaacagcaaaaagatttccttaaaaagacataaagagggttgactataaaagattgctaattctggtccatttaaatgaagaaacttgctcatcaaaaatcagctttaagaacagaaaaggcaggggccaaatgtggtggctcatgccttttatcccaacattttgggaggccaacacaggaagattgcttaaggccaggagttagagaccagtctgggcaacaagcaagaccccatctgtacaaaaaataaaaataaaaatagctggacatggtggcatgtgcctgttgtcccagctacttgggaggctgaaacaggaggatcacctgagctcagtagtttcaggttacagtgaggtaggatcatgccactgtactccagcctgggcaacagagtgagaccttgtctctaagaaaaacaaaaaacaaaaaactgaaaaggcacattgtaaagtagattttttcattatatgcaaatgataatggatcagtattaagagtatgtaaagaactcctataaaccagtaagaaaactacagataactcaatagagaagtaggcacaagatggagacattttgcagagatggaaatatttatagccaattaatttgtgaagagatattcccaacattagtgactagggaattaaaaaggaaatgtaagatatttttcatagacaagactggcaaaatttttttcaaaatcaaatgttggagagtatgtatatctacaggaaccctgctatgttgctgatgagagtacaaattggcacaatactttgcaaaatttctcttttaaagttgaacattaatgtagctcatgacaccagcaattccactgtacaacaggaggcatgtaaatgttcgataggacgcatgtaaagaaagtctttagaatactctttttcgtacctaaaaaccaaaggtctaccaatgagtgaatgaatgaattgctgtatgtattttcaatggactattatacaccagttaaaacaagtgaagtggcatatgacaatattgtatatcttgtaataggtagaaagtgaaaaacaaatatatttggtaaaaattaagataatagacatatccataccagatgcatttaaacaattgcttgtgagggggcaaatgagaatggaaatgaggagaaaaggaaaaattttaaaatacaaatgtattattatatacatacattttatatatgtgaatgtgtatgtatcgatacaaatatgtatgtatgtatatggtataataatatttttccatcttcctcattgttaagttgcatggctcaactgcaatatagtgacatgattgaagagatttcatggcttcattcccccaaactgtattccatacacatagcagctataccttcagcttcaacattaacaatcctttgaagccaagacattgtatctctaggagcgacctcctgatttgctattaaactagaccataaccaattcttcttgtgtgacatgagttatttggtgacaatagaacctggctgggggggaatggttatgagagtgatgagttctgatgtgaggcaaatccagagttccttgtagatacagaatattagtgctagggggacacagcacaacttgggaacttctggggaccaggagggtactcacactgtgatggggaagaagaagagaatgttattttctattacgttcacactgctttacgatgagtcaaggggaaacgcgttgggaaagggatatgggtaaggttggagaatatggagaagtaattttactttttgaacagtttctccctcatgtgctgtgtgagattcatatcctcaataggagcctcatctgtttttacttcccatattaaatacaaacagtgcattaccctcttctcttacttttgtcacctgttcctgtaggatatgtggtgtctagagttcttagggagtcctttggctctcccaatattgctatttcctgtacaagaatttcaagcttctaccagaatccataagaagccccatccaggtgtaatggatagaaggaagatctgaaaacatgaatctgctgccatctttgtgaccttcccttctccctgcgtaccctgtagtttttcatcctgatgcaatccaatccagggacattcagtggcaatggcttctagagtggaaggcctggcgggagcatggaacgtgtgtatttggagtggagttggctattgtaatacttagtgaatggaatttcattaggtccttatctgtgtgcactgaggaaaagaggtccttttacacagtgcttgtaatggagtggaaaattgcatttccctcttgcccgaacagtgccattagtggggaggcagactgtctgctgagtgcaggaagccacctcgggcagtgcagggctgacagcccaaatgatggcagtgccgagagacccggaagatattaaaataaaaacagcttgtggtgttctttttgtcctgtagcagttcttccctgcaatgcagggagtgattggatttgaagcactgagaaaaacatgttaagtaagaaattgtttaaataaagttgtttgaggttgaaactctcccccaggcatggagggaaatgtagttagctgcgtgcaacttacagatatccaagaggcaccatggtttttttgagtcaggcaagtatgcagtacacttaaaaaatgaaatggacaatgagatctcttctttggtcatccaggtgggttccagccccacctgggaggtgtgtaggccctctgatggcctgttggtggatcaaatcaccatttttactttccttggttctcagaattgcaggtgagaatagctgtgagtctcactgcaaaaaacagcaagagaattactcagctctggggaaattgttgtttctaacctgatagggttcctttcttgtgggttggtgttagacacagtcccatggggagcagccagtgtgatagcagaggaggtgcacagcctgtccttgccgaggaaacagaatctatgcagctcctgggcccaaatacatccaaatacaaagtggtgcagactaggaatgttgggaggaactatgagtgcaagagcctttcatgattgcccaaaggcactgggagaatgcaattaaagattttgtcaccaccaggcctgccctaaaagaactcctgaaggaagcactaaacatggaaaggaacaaccggtaccagccacggcaaaatcatgccaaattgtaaagaccatcgaggctaggaagaaactgcatcaactaacgagcaaaataaccagctaacatcataatgacaggataaaattcacacataacaatattaactttaaatgtaaatggactaaatgctccaattaaaagacacagactggcaaattggataaaaattcgagacccatcagtgtgctgtattcaggaaacccatctcacgtgcagagacacacataggctcaaaataaaaggatggaggaagatctaccaagcaaatggaaaacaaaaaaaaggcaggggttgcaatcctagtctctgataaaacagactttaaaccaacaaagatcaaaagaggcaaagaaggccattacataatggtaaagggatcaattcaacaagaagagctaactatcctaaatatatatgcacctaatacaggagcacccagattcatatagcaagtcctgagtgacctacaaagagacttagactcccacacgttaataatgggagactttaacaccccactgtcaacattagacagatcaacgagacagaaagttaacaaggatacccaggaattgaactcagctctgcaccaagtggacctaatagacatctacagaactctccaccccaaatcaacagagtatacattttttttcagcaccacaccacacctattccaaaattgaccacatagttggaagtaaagcactcctcagcaaatgtaaaagatcagaaattatagcaaactgtctctcagaccacagtgcaatcaaactagaactcaggattcagaaactcactcaaaactgctcaactacatggaaactgaacaacctgctcctgaataactactgggtacttaacgaaatgaaggcagaaataaagatgttctttgaaaccaatgagaacaaagacacaacataccagaatctctgggaaacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaataccttcaaaaaattaatgaatccaggagctggttttttttgaaaggatcaacaaaattgatagaccactagcaagactaataaagaagaaaagagagaagaatcaaatagacgcaataaaaaatgataaaggggatatcaccaccgatcccacagaaatacaaactacgatcagagaatactacaaacacctctatgcaaataaactacaaaaatctagaagaaatgggtaaattccttgacacatacaccctcccaagactaaaccagaaagaagttgaatctctgaatagaccaataacaggctctgaaattgtggcaataatcaataacttaccaaccaaaaagagtccaggaccagatggattcatagccgaattctaccagaggtacaaggaggaactggtaccattccttctgaaactattccaatcaatagaaaaagagggaatcctccctaactcattttatgaggccagcatcatcctgataccaaagccgagcagagacacaaccaaaaaagagaactttagaccaatatccttgatgaacattgatgcaaaaatcctcaataaaatactggcaaaccgaatccagcagcacatcaagaagcttatccaccatgatcaagtgggcttcatccctgggatgcaaggctggttcaatatatgcaaatcaataaatgtaatccagcatataaaaagaaccaaagacaaaaaccacatgattatctcaatagatgcagaaaaggcgtttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggccattaggcaggagaaggaaataaagggtattcaattaggaaaagaggaagtcaaattgtccctgattgcagatgacatgattgtacatctagaaaaccccattgtctcagcccaaaatctacttaagctgataagcaacttcagcaaagtctcaggatacaaaaccaatgtacaaaaatcacaagcattcttatacaccaataacagacagagagctaaatcgtgagtgaactcccattcacaattgtttcaaagagaataaaatacctaggaatccagcttacaagggatgtgaaggacctcttcaaggagaactacaaaccactgctcaattaaataaaagaggatacaaacaaatggaagagcattccatgctcatgggtaggaagaatcaatatcatgaaaatggccatactgcccaaggtaatttatagattcaatgccatccccatcaagctaccaatgactttcttcacagaattggaaaaaactactttaaagctcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcagtggaacagaacagagccctcagaaataacgccacgtatctacaactatctgatctttgacaaacctgagaaaaacaaacaatggagaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcagtggcaacaaaagccacaattgacaaatgggatctaattaaactaaagagcttctgcacagcaaaagaaactaccatcagagtgaacaggcaacctacaaaatgggagaaaatttttgcaacctactcatctgacaaagggctaatatccagagtctacaatgaactccaacaaatttacaagaaaaaaacaaacaaccccatcaaaaagtgggtgaaggacatgaacagacacttctcaaaagaagacagttatgcagccaaaaaaacacatgaaaaaatgctcaccatcactggccatcagagaaatgcaaatcaaagccacagtgagatatcatctcacaccagttaggatggcaatcattaaaaagtcaggaaacaggtgctagagaggatgtggagaaataggaacacttttacactgttggtgggactgtaaactagttcaacccttgtggaagtcagtgtggcgattccttggatctagaactagaaataccatttgacccagccatcccattactgggtatatacccaaaggactatatatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatagatgaaattggaaatcatcattctcagtaaactattgcaagaacaaaaaaccaaacaccgcatattctcactcataggtgggaattgaacaacgagaacacatggacacaggaaggggaacatcacactgtggggactgttgtggggtggggggagtggggagggatagctttaggagatatacctaatgctaaatgacgagttaatgggtgcagcacaccagcatggcacatgtatacatatgtagctaacctgcacattgtgcacatgtaccctaaaacttaaagtataataataataataataaaaaagagtctccttaaatactgaatagagaaaccattaggaaatttcatattcaagctacagaagaattacctggtccagccatttcttgtagagatgaggaatttctttctctgaaggtgcaagtatcaaagcagactcccttgaggctcctacctctctctaatggatgtgtctataatgttatagactgaatcatgtgttcccccaaaattcatatgctgaaatcttaaactgcaatgtgatggtaataggaagaggggtcctcaggaagtgattaagtcatgagggtggagccctcataaatgggattaatgcccttacctgtgggctcccagagagctttcctgctctcttttggccctgtgaggatgcaatgagaagtaggcagtgcagctccagagagggctcccaccagaaccaaccatgctgacacctgatttgtgactttagcctccagaactgtgagaaaattcctattgtttcagccacccagtctgtggtcctttgttatatcacctcatttgactgtgacagcatctcttcgtggtcttttctctgttttcttgtccactctttcctccagctactcttctttcacttcctctttgggagaattgtctttctacttggtctatcccttggcctcagccttctgttcttgcctgccggatatggaaggttgactgggatcagctacctgccaaccattctgttctctagtttccccaggtattccttatgtctacataagttagggttgggaagttgtggctgtgcctcagtagggcccctcagcatcacagtggttgctaagccctgtcctaggacattataattttctaaaaatttatatgactctcaaattctatatgaacacatatatcattatgttaaaattattaatatatttaaattagtaatgagggaaccagtgatgtggtaaagctggttctaagagcacttgaggaactgggtatgtataagcactgaaaaaaaaaaaagaatgggggccaggcatgatggctcagcctataatcccagcacttttggagaccaaggcaggcagattgcttgagcccaggagttcgagaccagcctggaggaaatggagaaatcccatctctacaaaaaatacaaaagttagccaggcatggtagcatgcacctgtggtcccacctactcaggaggctatagtaggaggatcacttgagcctgggaagttgaggctgcagtgagccaaggtcatgccactacactccagcctgggcaacagagccagaccctgtctcaaaaaagaaaaaaaaaatgttaggcaaggattgctaggttagattcaaagctggtcagtattctacagagcaataaaataataatgtctaggactctttttttttttttttttttttttaccggacaaaaatctacaatttaacatgtaacttcattgtatctaggttgtgatcaagtaatgagcagtgaagtcaaatataggtatgatctaggaagaattaactaacccttgggaagacctgttcacaaagataaaatatgccattgaagggatattgtgtccttccttgtccccctacccctttacatccaagttttggatgctttttcttaacaatataaacccagcatttgagtctatatttctttgtaaatgtaccagatatggtatatctggttctgttatgactccatcttgaagtaaagtcccagctagtatgtcaggtatccactaattaattaaacgtttaacacatttattgagttgtctctgtgtgctatggtttggaaatatttgacgccgccaaatctcatgctgaaatttgatccccaggccgggcacagtggatggctcacacctgtaataccagcactttgggaggctgagctgggtagaccacctgaggtcaggagttcgagaccagcctggccaacatggtgaaaccccaactcaactaaaaatataaaaactagctgggcgtggtggtgggcgcctgtaatcccagctactcaggaggcagaggcaggagaattgcttgaacccaggagacggaggtttcagtgagctgacgatgacacgatgccaccgcactccagcctcagtgacagagtgagactccgtctcaaaaaaaaaaagaaaagatatttgatccccagtgttggaggtggggcctaatgggaccactttttgggtgatggggatggatgcttcataaatggattggtaatgaatgaggtattgctctattataagttcctgtaacagctggttgttaaaaagagcctggaacttcctcacttctctctcttttcttctctctccatgtgatctgtacatacattggctcctgtattagtccatgttcacactgctgtaaagaaatatctgagactgggtaatttattttatttatttatttatttatttattattatatatatatttttattatattttaagttctagcatacatgtgcacaacatgcaggtttgctacatatgtatacatgtgccatgttggtgtgctgcacccattaactggtcatttacattaggtatatctcctaatgctatccctcccccctccccccaccccacaacagcccccggtgtgtgatgttccccttcctgtgtccaaatgttcctattgttcaattcccgcctacgaatgagaacatgtggtgtttggttttttgtccttgcgatactttgctgagaatgatggtttccagcttcatccatgtccctacaaaggacatgaactcatcattttttatggctgcatagtattccatggtgtatatgtgccacattttcttaatccagagactggataatttataaaggaaagagatttaattgactcacagttccagaaggctggggagacctcaggaaacttacagtcatagtggaagggaaagcaaacacattcttcacaaggcagcaggagagagaagtgtgagtgaaggaggaacttgcctaacacctataaaaccatcagatcaggccgggcgtggtggcttatacctgtaatcccagcactttgggaggctgaagcgggtggatcacctgaggtcgggagttcaagaccagcctggccaacacagtgaaactccgtctctactaataatacaaaaattagccgggcatggtggcacgtgcctgcaatcccagctacttgggaggctgaggcaggagaattgcttgaactcaggaggcagaggttgcagtgacccgagatcacgccattgcactccagccttggcgacaagagcaaaactccatctgcaaaaaagaaaagaaaacaaaacaaaacaaaaatcagatcttgtgataaatcactatcacaagaacagcatggtgaaaaccgcccccataatccagtcacttccctccctcaacatgtggggattacagtttaagatgagatttgggtggtgacacagagccaaaccatatcaggtccccttcaccttcctccatgagtggaatcagcctgaagccctcaccagattcagatgttgtgacatgcatcttgtacagcatgcagagctgtgagacaaataaatctcttttctttataaattacccagcctcaggtactcccttatagcaacacaaattcactaagacattgtgtcagattttaacgtatactgatgaataaaacaagcaatgttgtgaggttcatgataagagaaatacatggcatatactttagaaaaaaatattatggaaagcctgtcaaagtgcctctacctgttatctgaatcacatgatggagtgaattccccatgcctgtttgcctgaattagttcagataagcaggagttggttatgttctatcaaattctgtgaggtatgaatggaaaaaaggaatttagaatggtttttcatgttggtgtgaccttgtttactgtgttcctccttggattcaaagtctacccaataagtaatatcagtaaatatatcggtaaagtatattgaagcactagctgtggacttttttttgtttatttattttaagatttttgataatcatcctaaatctattcttatgcaagagtcttaaagtagaaagtttctctgttttttcttccttcctaaactccttcaatgtgattgacaactggctccatgaacgtggggcattgtacctaccaactgtaatttttccatcagtggaaatcttgcaagtctttgacagacagagtagaatgcagaggttgtggatagtagtgaatttcccaaggccctgatagttttagggtgatttttgtttctcaagattcttttagccaaattgtaaagccattcttgtaatcaactgaatttcccctttgatattatccccaaggaagagtaactacattagtgttaagaccagagaatcacagggcatatcctatagtctctcatagtatgtcctattactggctctctgagaaagggagacaggttggttttaatatcgcatcagtatgtacagtattttttattaaatactggccaagtataagtcacttttaggccataagagggatatagaggtataagaagagaaactcacagagtagttgaggagatgagatacccacagaccacatagatacttatataagaaaatgtgtgcagaattttgactcagcattccaggctacagtgctcacagagttcaaccagtggggactgtggagggcatggaaggttcttaatggaaattgttagtcttttttttttttttttagacagagtctcgctctgttgctaggctggaatgcagtggtgtgatctttgctcactgcaacgtccgcctcccgggttcaagtgattctcctgcctcagcctcccgagtagctgggactataggcacacgccaccacgcccagctaatttttatatttttagtagagacggggtttcaccatgttggccaggatggtctccatctcttgaccttgtgatctgcccacctcagcctcccaaagtgctaggtatgagctaccacgcccggcaggaaattgttggtcatttaatctattttaaccacccaaggggttccttggtgccctctgcataaacaaagaccatggcattgtaatagacggagtttaatagacaccaggccaggcatgccatgtgggagatgaagttcatactcaaatcatcttgtccagaattcataggattggcgtttttcagacagtttggggtaaaggggtaaaggtgatcaggtaacagacacttgccgctgattggttggggcaaagatgaaatcatagggggttgaatcggtcctcctatgcactgaatcaattcagggtggggccacaggagtggggttggcgagtccaggtggagccatgggtgtcagacatgcaaaaaacctggaaagatatctcaaaaggccaacctacaatagttgtgttatttgcaggagtaattggggacattgcacatcttataacctccagaataatggctgacaatcatttatgcctgcaccttagcaggactcaggttctcctctgcatagcctgataggctcccactagctttacaaaaagcacttgagttttgggcaaggcctattatttaaactatagcttaaatgttttccaaagttagcttggcctaataactcaggaataactaagggaaaggcaagatgtggggaaggttagcttagcttactgttataatttttctcactgatacagtttttgcaaacatggtttctctatgaaggataaatgcaatctggattatagtagaagcaggagatgttgaaattctaaggagaatggagctgggacaatggaatgcgaaggtttggacaataatataccaagtatgtctttgttgggcgagaacgtctgttgaggtttggtatttgagtctgagaattgaaatgacaatagaccaatcaacaggagaaaaggtacataaatttactacaggcatggggcatcacaagagacagagtgcccaataaccccgtgagattcgaagcttatatgcccttctccatgggagagagtagtgggggtctgcaggcacttttagaggaaaaagtaaatgatgtttaggagagaagaatgggcatcaagaacagatgatgtcctgggacgaagtctgtctgggctctgagtgtgctgtgtactctagtcttcatttctgcaagttaatcttccctgtttgatgagattatagagaggtgatgcaagacaattgcattccttctagaggaacttcccttagtcagatgagggaacttcagaaaaagccgccctctgtgcttggcaagaggtagaggggtgagagagggtgggcagaagaaggtcagactctggttctgagactgcttctttagttcaaaatactcagcatatcaacacccccacactttgaggtatctcttccgagcccgtgtctttgcgggtgggaggttggggaggatccagtctgggcttgggagttggtggcatccttttttatagctgctccaggagcacccaacctgggtgtgtttactgaagttgtacgcatgctcctttgagccattttcgacttcaccattttgccccttagttcactttcttaagcccattcacccaactcctgagatcttttcaggaagctgctgataaccagtttcaggtatttctatctattggtaggctgcctttccctggagccccctgggaccaattattattttagcgaggcagtgtaataactgcctgaccatcacctgatggttgcctgacattcctggtggggtaggggtgggtctctcctgccctgctgatgtctgactgcctacctactgtaacaccctaactaaaagttgagttaactctgaaatcaagcaacaccaagcagaaagcagagagggaaacttgtccctttcaaaacagattaaatgtttcttattaattcagttgcttccacacatattcaagtttgtatccagaattaagcgagtcagtagttttaaatcaaattacaaatacagcatccttcatatctgaaataattgtgtatctgtatgtaaatgctgggagaatatacttttttggatattattctgactgtagtttcaaaaaaaagtagatagaaatctggaaaaatgagtaaacactattaattagatgagatatttatccttggcttaaattagaaaacttactaagagaaactatgaaaatatcaattaaaacaactagcatgattttatttttcactgttaagagggcaaaaaaaaaaaaaaccccaaaaatcccatgcatgaataaaataaatatatatttggggatgacaccatcttggcatttccaggcattcttttctaaacatattctttatctgagctgtcttgcaatacttttaatataattaaaagcacataatgagtgccagacttgtcaatttcaacaacaaagtgctgaaatttgcagtgaaactgagagatccatctcccatacattgtaatgaataggttcataaaaggaaaatagtttaattacattttagttcatggattgttaataggctggagtatctaaattgaataatgtgattctggtaataattatgtgtaaatgaacttgtttaaatgatattttacagcttctttataaaattacagctagaggcaatccagtgatagacagacaaaggccatgcaaaaattatcataaactattagcttgtttgcaaagggttttatgttaatcttttagtacttaaagcaatctgcaattaacatatcatggggagctgcctccgagcaaaggcatgcaaattgaagtgcttagataaaaagccattcatgttgtgggggaaagagaaagaaagaaaaaagaaaaagaaaaaaaaatcaaagaaagggtggcaaagtactcagagggtgctggtttttatatttgagattaaggaggtgtaatgattgtgttatctaactatggctgtaattaaagcttttctccagcagacatgacaatagatactgcattgatttcggtgttttaattgtgaaagtcattttatttcagggcagaagatatgaatagcctgaatcaaagggctagaagattgctttgttgatagtacttgttcaacagctgcctggctgcttaatacacaagtgtggagaatgcagagagacccaaggaggtgctgggtattgtgattctcctgctggtttcctttccttttatgaaaaaggcaaggatcttggtgctgactgtaaacaaacagccttttcatacctcatcgatgtttttcctccccaactttgcagaacaaaagaagtcataaagggccttgaactaactttactactgctccttttaagctacagaagtttatgcaaagtaataaaaaccatctttgctagtggagatatcacccctctaatgatgaaaaaaagtctctgagtgactgtggtagttattatcacaaatagccttgtgacagaaacagtttgtaggagagaggttggattatttacattaagggcatatccacaaaatctcacacacagttagtttgagattagtgctttcttatcagtttctatatacaaaccacaggagggaaattaagtgaggggaaaacatatacaatcccagagcaaagagaattctaaagagaattttagggagatcagggtagacttaaaataaaaatcacattcttggctatttcttctataacacttcagtgtaaatggaggtgaaacccagtgatttccagtaattcctattctattgatttatctcttctttgttcctagaaatatcaaatagcatgtttaaaggagtctgaataataataaacttggttttagggaacactgtttctttaagtgatatgatttaaaataaccagacaccaagatattacaaacataacaataataacataatcatttactgagtgttgtgctatttttatttatatttctgatgatataagggagtgaaaattttccctctgccctctgagagtttgataattgaatctatggaataaatggacattagaccaattaataggagaaaggacacataaatttattacatgcataggagcatcatataaaacaaaggtgaacacccagtgagatctagaagtttttataccctcttcataggggagaagagagggggaatgcagacaacttagggaaggtacaagcataccttggagatattgaaatctcaattctagactgatgcaggattttcttcttggtcaccgtgcaagctggagacctctggccagcgatgccctaccctggccttgctcgaccacactagctgctgcaggagatggcctctacctgctgtaggagacggcctaagtctggcttacacactggttcccgagttcttgtcttgcacccaagaaaaataaggatgtactgacaatggaagagtgagccagatggggagttttattggtgatgaaacagctttcagtggagaggggacacaggggtggtccccctacccaaaggtgggaaagtcccctgtgtgtctgggcctggggccttttatggactcagaatggggagtgtgtgctgattggtttgggggtatgcaaaaaagtttaaaccaaagacaccactcaaaggtgggcatgacagtgaagaaaaccaattacgaaagggtaggtatatgtaaaataggtgaaaggtggggacagtcagagaaaagtgcgccaaatgggaagacaagttctcagtctggtccaagaatttaacttgtagcttggctttcaggcttcaaactgtaatcagcttggaggtgggatttcaccggggacccccactgtctgcctaggcatttggctgcctcctttcactatcaagactgccccaataaaacaaaaattgcaataaagcaagtaacatgaatgtttggttttcccagtgtgtataaaagctatacaatactgtagtctgtgaggtgtatgataacattatgtctaaataaacaatatacataccttaattttaaaatactttattgttaaaaatgctaataactatctgcattttcagttagttaccatctttttgctggtgaagggtattgtttcagagttgctggctgctgactgatcagggaggttgttgctgaaggttgggatggctgtgacaatttcttaaaagaagacaacaatgaggtttgccacattgattgactcacgaaagatttctctgtagcatgtgatgctgtgtgatagcattttactcacattagaacttcttttaaaattagagtaaatcctctcaaaccctgcctatgctttatcatctaagtttagtaatattctaaatcctttgtggtcatttcaagaatgttcacagcatcttcaccaggagtagattccatctcaaaacaaacaaacaaacaaacaaaaaacactttctttgctcatctataaggagcaactcctcatctttaaaagctttatcatgaagttgcagcaattcagtcctatcttcaggcttctcttctaattctggttctcttgctatttctaccacatctgctgttatttcctctactgaagtcttgagcccctcaaaatcatccgtgagggttggaattcacttctttcaaactcctgttaatgttgatactttgacctcctcccatgaatcacaaatgttcttagtaacatctagaatggtgaatcctttccagaagattttcaatttctattgcccagatccatcagaggaatcactatctatggcagcgatagccttactaaatatatttcttaaataagaggacttgaaacttgaaattactccttgatacatgggctacagaatggctgttgtgtgaggaggcattaaaacagcattgatctccttgtatatcttcatcagagctcttgggtgaccaggtatattgtcaatgagcagtaatattttgaaagaaatcttttttttctgagcagtaggtctcaatagtgggcttaaattaatatttaagtaaatcatgctgtgaacggatgtgctgtcatccaggctttgttgtttcattgatagcacacaggcagagtagatttagcgtaattcttaagggccctagaatttttggaatgataaatgaacattggcttcaacttaaagtcgccagatacattagctcttatcaagagagtcagcctgtcctttgaagctttgaagccaggcattgacttctctctagctataaaagccccaaatggcatcttcttcccatgtaaggctgttttgtctacattggaaatctgttgtttagtgtagtcaccttcatcaaatcttagctggatctcctggataatttgctgcaatttttccatcagcacttgttgcttcaccttgcccttttatgaagacagcgtctttccttaaaccttatgaaccaacctctcttagcttcaaacttttcttctgtagcttctttacctctcagcctttacataaatgaggagagttaaggccttgctctggattaggctttggcttaaggaaatgtcatggttggtttgatcttctatccataccgctaaaactttctccatatcagcaataaggctgtttcactttcttatcattcatgtgctcactggagtagcacttttaatctccttcaagaacttttcctttgcattcactgtttggctaatcgtttggtataagaggcctagctttcagcctatcttggcttttgaaatgccttcctcactaagcttaatcatttctagcttttgatttaagtgtgcctctttctttcacctgaacacttagaagccattgtagagttataaattggcctaatttcaatatcgttgtgtctcagggaatagggaagcctggggagagagagagagatggggaaacagtcagttggtggagcagtcagaacacacacaacacttattaagcttgccatcttctatgagcatgattcatggtaccccaaaacaattaggataatgaaatcaaagatcactgatcacagatcaccataacagatataataataatgaaaaagtttgaaatgttacccaaattaccaaaatgtaacccagagacgtaagataagcacatgctgtgggaaaaatggtgttggtagacttactagatgcagggttgccacaaatccttcagtttgtagaaaaaatagtatctgtgaagtgcagtggaatgaggtatacctgcagaggatttctgggaaagatgaatgggccctcagaataggtgacagcctgcgacagggtctttctgggtgtggtgtcacctctattctcctctcttgtgatatagataattgtccctggctgataagattctacgggagggaattcatgactattgagttacaggagtagaagcttggaatttctgggggctggcagggacatgagttttgggaagatggggttagaaactgtatgacgaataagggttgtcttcttatacagattaaaagactctcaggtcataacagttttctgcagctagcagactttttctgatccagatagtttactaatgtagatttcctttacagatgtaagtttcttttacaaaaggacaagttttcagagctacttccgtgtgtgcagttcctcagagtaaccagctcgaaatatgccaaagaaatatagtttggggtggtacattctgtttggcgagcccaaaaaatgacctccaataaccatcccaaagaagtcgatgggatgatccattttctaaaacgagtgaacttagcctcaggccaaatatattgttcaaggtcacatagcaagggaggggcagaggcaggttagaacccagacagtctagctagatctctaggaaagcctgatgccatcctcacagggttaacaagaattctggacagaaatgtagttataattaagcattaattaagcaggctgcactttgacccagttccttgtaactgaaagtcaggtaacaccagatcctgactatttgcatccccattgttcctatagacaggatttctggagttacatcaggcttttaagatagataggatctctgacactacaatcataaggtttatgtttgagaattgcagatgcagattctgaattccagtggaacagctaatgctaaccattttgaagaccccaacagaggaactgaatcagcatgagaatggtttcttcatctccctgtcccatgacttactctgcactctttaaccaatcaatggtctccacactttggcccgctcccagacctttaaaaaccctagccccaaactccttggggagatggatttgaggtttccttctgtctcctcgtttagtggcctatgaccaaacttctttttctgctgcaacccagcatcttggtgtattgacttgccatgaacatcaggcagcaaacctattatggtcacaagcccttagacttcttctctgattaatgttttctaagtgcacaaaataaagtacaaagggttacaaagcaaatgtagtatattgaaatactgttatcaaaatatttaaaaataaaatttatgacttagtaatttatgtgcttacagccagcagcaactataatttcaaagctatgctaacatctactataatttcaaagtgttgataagcataaacagtgttttggatttctgcaataatgtgacatgaaaatacctgattttttatcaatgataaagtcacagatactccttaaactccagtcattttgttgcctacatttataataaaagaaaatggggctgaggccagaggattgcttgagtcttggagttggagattgcagtgagctatgactgcactactgcattcgagcctgggcaacagagggagaccctgtctcttaaaaaatagcaaaaacagaaagaaagaaaatgttaagttccccataaacattactgaaaataaaactatatttttatatatgtcagatattatacaaaaatacatgtgtagataattatacataaaaataatttttcccaccaaaattcacagacctctaaattctataggtgtacaaggcttaggttaagaacatttttggttttacagatgaggaactgaggcccagagaagggaatttagtgacccaaggttatcagtaatcagtgataagatgtagattagagctgattacactaagagaacataaggaaaacttaaaatactgtatgttgatcttttccctttctcctgtgactttggtggcttttgctgacatgctcttggaatgttgaacctttctttgtctttgcaatgttgtctttttcaaagtgggagcagcaagcaatttccccagccctgagatcagttgttggcaattcctgctttcagtggcagggctgggaggatcccagaaagcgcagccatagggactccagggaagcttcctgtgattgcaacctaaatttgaaaactttctatttaaagggacaagagtgcttttttttttttttttttttttttaagatggagtcttgctctgttgcccaggctggagtgcaatgatgtgatcttggctcactgcaacctctgcccctgggttcaagcaattctgctgcctcagcctcctaagtagctgggattacaagcacgtgccaccacgcctggctaatttttgtgtttttagtagagatggggttttgccatattggccaggctggtcttgaactcctgacctcaggtgatccaccctccttggcctcccaaactgctgggattataggcatgagccacggcacctggctaagagtgcatattcattatgtgtctcctctacgcgaggtctttgtatatcctcttccagttaatattcagagaggcctaataaatagtccccatccttgttctagaggggaagagagaaactcagagattgccatggcacatggtgcttgtggtgagccggggttgagttagactttagctatgtcctcacagcctaatgacgcaggcaatttggtcctctatttacttattaggaaactgaggataaaagacttttagcaagatggccaagttcatgacttattaagtgacagagccacgaatttaactgaagtctgttgcctgtaatactcatctttgttccccagactctgttgcccttacattgaaggaataaggacccccccgccctcccatcttctctacccaggggtcttctcctcaggtgtctattgcatatctgttatttacagggcatgtcccatgtgggcatgcaggaggggaagggcagcaggtagaaacacataaggatatacttgattttgagctgactttcctaacgtccctaattggataaataaagctaacacaaagggaacacacagataatgttcgatgacaaacacggacaacatcaacaatgtaataataataattgtgatgatgatgataatagctaacatttattgaatgcatactattttaaggattttccaaaagttgtttctttttttttttaatttgatcacatatcccataaagaagagtgtgtgatggcgacggcacccttacacacttggcaggaaggacatggctgagggtgccacagtcataaacacagaaacacagagatatatgttctccttattgattttgtaataatattggtggcaatcttagctatgaattgagtgaacaggtattatgggaaaggaagggggtgagatggatcaaccaggccaactcccagggggccatgttggcaaattttcctgcctcatgccttgccttggtgacgtacaaattttaggcattttaaagaaataccccaaactgtcagccctgtgcagagggagcatggttcactccctagatagtcaatttgggtgatagggggtggccagctgcttgcttgggtctcaggggagaggccctgatctttctggtccttctcccccaatcctaacctcagcccagacatcaggtcatttctacacactgcattaggcttctctaaccaataaggaacatttacccttaaacatggtcaccatgtcattatcacaactaaaaaaagaataataattccatagggcttttcaatacccagtccatattctaattttcccagttgtctcaaaaatatctttttgtatccagttcgtttgattcagtgtccaaacacagcccataccttttattgcgttgctgtatccctttgatcttttttagtctttaatcatctccctccccttctcctttttcatcttctctttgtctcttatgctctctgtttctctctctgtctctctctctctattatgcattgatatttttgaggaattgaatgagttatcctgggcaatgacccacattctgctttggctggttgcctccttgccatgccatctaacttgttcctctatcctctgtactttctataatctggtgtcagatcaataacttgtttgaattcaaattcatttttttttgtatatggtgctgtatacttcctattgcattacctcctgagatgcataattaatatctgatcatggtaactctgtgaggtgatgggtgtgttaattaatttgattgtgctaatcattacattttatgtatatatacttatatataatgtatatatacatacacaagcatatgtcgaattattacattgtacaccttaaacactatatacagttttattggttaattatatctcaatatagccgggaaatttttaaaaataaaaacaaaaacaatcccatcaaaaagtggactaaggacatgtatagacaattctcaaaaaagatatacaaatggccaacatatgaaaaaaatgctcaacatcactaattatcaaggaaatgcaaatcaaaatcgcatacacacacacacaccacacacacacacacaccacacacacacatacgcacaccatagaatactacttaactataaaaaggaatgaaataatggcatttgcagcaacctggatggaattggagaccattattctaagtgaagtaactcaggaatggaaaaccaaacatcatatgttctcattcaccaccttactcccgcaagaagggccataataataaatatatgtaatatatatatttgtgtatatatatgttatatataatatatacatgttatatattatatatatgttatatttatatatgttggcatggatgtggtgaaaagggaacacttttacattgttggtgataatgtaaactagtacaaccactatggaaaactgtggagattccttaaagaactaaaagtagatctaccatttgatccagcaatcccactcctgggtatctacccagaggaaaataactcattatatgaaaatgatacttgaacatgcatgtttatggcagcataacttgcaattgcataatatggaaccagcccaaatgcccattaatcaatgagtggataaagaaaatgtgagatagatagatagatagatagatagatagatagatagatacacatatatatgtatatatatacacatacatatatatgtgtgtatatatatatatacatatatatatacgcacacacacacatacacacatacatacacacacaccccatggaatactacttagccataaaaaggaatgaaataatggcatttgcagcaacctggatggaactggagaccattattctaaatgaagtaactcaggaatggaaaaccaaacatcatatgttatcactcataaatgggagctaagttatgagaatgcaaaggtataagaatgatataatggactttggggtcttgggggaaaggtgggtgggtggtgagggataaaagactacaaattaggtacagtgtacactttgcaggtgatgggtgcaccaaaatctcagaaatcactactaaagaccttattcatgtaaccaaacaccacctgttcccccaaatcctattgaaataaaaaattaaaaataaaactgtatcttatcagtaggttcagatggttcttccactgaaagaatcagctggagtcttccattgtaaggttcccaaccaaccttttacctaatgtttgagcatcttttgatgatggtgacctaagtccattatttcattacaggtgggagaataattttctaattttatcatccctttgtatttattacctggaattctgccatgaaggattttcttccatatagtaattgcttgaaatcttttttttctcacagcagataacttggtttgaaacatagtttctgtgggcattgactgtatgaaatgggaatatgaagtgtttccagatgcagcggaagtgggaggctgagggtcccctgcaggcacaggattcccttcatcctctgtacctgtagcagaggagcccttgggctccagcagtacaattggggaatgccctggtgaataacactgcctgacccccatcctcaccaggcttacaatgtggggtcctggagactgaagggtatgcctgtagtacagagagggtagccactcaccagcttcatgactttggggctgttggccacagtcaacattgcttccttatctgtaaagtgagaataagagtactaacctcacaggatggttgtgaagattcattatgctaatgcctataaaatacttggcatagttttggctgtataacagtgcttaataaatgctggcttgattattcttattgtaataatttttttttaagagacagagtattgttatgttgcccaggctgtagtgcagtggctattcacaggtgagatcccactgctgatcagcacaggagttttgacctgctccatttctgacctgggctggatcactcctccttagtcaacctggtggttccctgctcctgggaggtcaccatattgatgctgaacttagtgtggacacccaatcagcatagctcactacagcccagaactcctggactcaagtgatcttctcacctcagcctcctgagtcaccaggactactgactattgcattggtttgttaggattgccataacaaagtatcacaacgtgggtggcttaagaacaacagaaatttattctctcatagttctggaagccagaaatgggaaataaaggtgccagtgggcccaggctcctccaaagactctgggtagaatcctctcttgcctcttccccacttctggtggtagctggcaatccctggtgtgctatcacttatagatgcatcgtgccaatatctgcttttgtcaccacatgcccatcttttccttctgtctcttcacatggtgttctcctctctacatgttcacattgtcctcttagaaagataccagccatattgagttaagggccaaccctactccagcatgacctcatcttaactcattacatctgcaatgtctttatttccaaataagctgacattctgaggtactggggtttaggactcaacatatctttctgggggatacaactcaacccataacaattgtgtaaccatacaacaccgagttgtcctacatcttgacatatagaagggttccttgtactttattgttatgccacatttcttgcattttactgttttcctactggttttctctcagatatgagatgctatgtagtgcagagtgaggataagatgagcagctcttccacgtttagacccagagcagacacttgaataagtcgttctccacctccaaagacaggataggagcaggaaacatcagccagaacatctcgtataaacagcagaagcagtacagccttagagaacccatccacacctcagaacttcccagccaagctcatgctggcaggcacccagtgattctcccgtccgtatcacgacaagcctcggagtgaactgtttatttatcaattcttaattgagttgatgtttactcatgattgccagtggatgagtaatttactacagagttcgaggagtcagatagtgaagagatcattataaagagaaattataatagagttccctgtactcatgggtctggtaataaaagattgatataattagatggggcttggtaacaaatactattacattatgtctgaatcttatttaaatatattggccttttatcttaaacttattagtgggtggctgtagcttacgtcgacaccagctagctattttactcttgcaaaaggagggctgagctatacaaaggagtcaatcatttgatgtttagaagcaatggcacggtatttaaggcagttctccctgttgatttttagaggaagagcaaggtataaggggaacttaagcttccacttggtcacaaactttctggataacaaattcaggggctgtgtttctctgtactgtggctgtggctaccttggaacctttaacttggccaaagtcatccttgagaaagcagataaaggaaagggcaggaaataatctgacaacgtagtgagaaaatgagctgtggagtaagacaggcctgagatgaaaactttgccatagtgggttgagtggtagcccccccaaaatatatcgctccatcctatccctgggacctgtgaatgtgaccttcagtggaaaatgagttgttgaagatgtagctaaggatctcaagaaaagatcatcctggataatccaggggggctataaatcgaatgacaagtgtccttggaatagacacccagaggagagattaatggagaagagatatgaagatggaggtagaggctggacttatgtagagctattagggaatagatttctgttgttttaagccaccaagtttatggtagtttggtgcaagatccctgggaaacaaatataccagttttataataaattgcttatatgactttgggctagactcttaatctttacaaacctcagttttctcatctgtaaaagttgggttattacacttgtctctcagtatcgtgaggaccgtgaaagctcacccaactcagtgcctggtacatgacaggcattcagtacacatcagattccttctcccatcacctcctacccattttcctacatgatgtttcaacttgaaatctttttcatcttctacgcctcctaaaatgtctgcaaaactaacagccctcccctgaagaatgttccattcttcaggagctgttcttaggactgtcaaattagaggagaaagcatggtacagctggtgtttttgcggcagttgggtgagagccatgtagatattaaaagtttttcaaatgcagttcattgaatgcagccctatagagaagcagctgaagtccacattgtagctgcagtgtggctggccagctggggtctgtttccttcacacaaggaggtctcagggtacattcccagccatggagaagagacaacacatgggaggggagtgcgtataatactctgggctgcagaaagaagccaatgtaaatggctttttgcttgatgtctttagttcattgattttaggcctagaaagtcgtgattgattacatcccaccaaatgcaggctggggaagtcagtgtgggaatttagagcatggctgatttaataaatgttttcagaaccatgtattcttctgaggcatgagaacgatgagaaaaagaacactggtcaagagctagcagagctagggtctggcttcatttctgtccttgattagctgtgtgactttgagccagtcatttaacttctctgaggcttcaacttcacagtgaggttgttggagccgtacatctcagtactagcattcaatggttccatgaaaattcacagtgatccccatgaggtcagtgtccacccatgtagcacatgtattttgtttggcatgcttgctggggagaggagaatcacaggaaggcaacaagggaagaaaattttaaaaaatattggatgttctcttatatatatcatccagggcttcatccgtcatccaggggagaactagagatgttttaaagacttgagacctccactgcctggtcctattgaggatcctgtgttaatgacagttttgccatctctaaatggcattgaaaatccagtgcctgggaataagtaggcaggggagtgcctggggacatggccctgttataaggtagtggtgtttgtttttgggacattagccctcttcccattgtctgttatgttgaggtcagcttccatgtacatttccctatgtctccgagcacattctgatcaattcattgatggtgagagggaaggaaagggaaggaaatagacatttttaaatgcctatgatgagctccctactgggaaggatctgtattcacagccatcttatggggcaatcactttacccacattttatacattataaacctgaggcttggaggtgttaggtaagttggataaagtcactaaattattaagaagcagagccaggaattgaacacatgtctgtgtgagggcctgtgttttatttgccttggcatcctgcccttatactatgacagctctgggcatgcattgtatacaatacaccagactgatggaaagtagcagtggaggaggggaggatggggataaagacaactatgtatcattcttattcttgaacatattatctaattagacaaataaaactaacataaagggaatacctatgacaagttaacaattttatcaacaatataaaaattagagatacgatactagcagctaacatgtattacacggtatatgccacatactaaagactctacaattgttttctcaattgtcaccatgatcccatgtccatatttcattgacgaggaagctgagacataagagagttggaaactctaccaaagttcacagcctttgggcttccagcagtgagccaggattccaatccagcccaactggttccacgcggtactactgctggtgttatttgtcatcaaataagggaacccaaggcccactgtaggctcattaggaggggtgagtttggtctgaaatggtcctggcggactgaagggaggaaatgaaactcaaaaagcctgtatggaaatagccttgtggtcatatcagagatcaggtttctaacgcaggttcttaccacctcatggtaggaccttgcagtaattgcagggcttttcccacacctcctctcatgtctcatggctaacaacctgttttcttctgcattctaatctcctgagaattctctctaaaatggaggggtcattagaaggcagatatttttggagcatgtcttccctggggcaagcaagtgcttggaaccaggggtgcagggaaagccgtacgaatccacacctgactgtgggacagtaatagggtctgagagtgttaggtcctgcaacctttcttgaagcacagataggagtgagtacagcagaattacggccctggattagtccaactggcattgctcatgtaaaagcaagagctttgtcaactgcaatcccactttaaagggtgtgtgggattgaaacaagatggcttgaaggaagagaccagtgcctgtgctctgtctttgcattgcacacaagtgtcccttgtcctgaaagaccaggtggactggataactgcataacaaagatgggtgctgctaagggatgaggggatacaaaaggggagaggctacaaatggcagagccaggtcaggtcttggagagtaactagtcacagattgcagtcagatcctgggctaacatattttaagtgaaaacaatggatttaaatgccattaacagagcatgtattctccaggttcttttataccagccagcttcactcattccagtgacgatcttgtcttacctcctctgtccctcactccttcactcttgccccagctatcccagaatagcttaactacccagagttgcatatcaagaaattgtgagttgaagagaataaagtgacttaaatagatgactgtttatggggttaaaatacaaaactacattttctgatttctagtttgatatttctccacaatgctgtactgaaagctggatttttctgtctttaaggcatggagaaaagtgagggagtcttggggtttctcagaatttgaggcaacatccttaacattgggcgaggtagtctggctattaaccatgaaaccctatggagtgagcttagttgaaggggactgagcaagccatttcagagcccagggcctctgtgacaaccaaacacatttgctatttggaaaataattatagatccttttgagagattcagctgcggataaaactggaatactctggctagaaaagtacttgctatgaaatccattcacctagtgtgatagattgttaaaaatggccacttttattctatccctgtatgcatgaatcccccctgcctcccgcaacccaacccagcaaggtgtctgtaatattcctcctatcaagagtagagtttctctacccacctcttgaatgggggcttgaccttgtgacttgttctggtcagtagggcgttagcaaacatgatgtatcagaggcttagaaagcatttgcatgtggggtcctaccctcttcttgacaccctaagactgccatgtaaagagattggagtgccttccggaggttgagaatatttggagcagacaaaagtcatcccagcagagactccctggaccaacagtgaaggtacctgcatttttgctaaaaagtccaagtggaagggtattgttatatgcagtcctatcatgttttctcaaataatggggaaaggacacaggtgtccatatatgctcgtgaatccagccgtcttcattggaaaacgtgtggcctgcagagattcagtggaatgatcttaccccaatagtccaggacagtggctctcaattgggagctattttgactcccaagagtcatttaataatgtctggatacatttttaatttttgtacccccagggcaggagtatgctactggcatgtagtagatataggctagggatgctgccgaacatcctaccatgcacaggacagtccccacaaccaagaatgatcaagtctgaaatattgatagtgttgaggttgagataccctgatctgggcaattgttgacttcatgtcaggttttacagagttccttaacatatctaggcaatacttcaccagactccaaccctagcctcatcttcttcaagagcaagttctctctttgggagtctctgaagagtccgtcaaaaacatttcttaacatcctaagacatgcctctttagggttggataaagatgattttctaattttaaaatgccttcctagccccagattttgtgcttatattgcagagaagtagattgaataccggagggaaggacatggatcaaggtggaaagtcagacgtaagcagagctacatttgcagaaagtatgagttcagtttagtttttgcttatggaccacaaagatggccctcacctctaaaccttgaagaattccagaatttttctgggagaggaacatctctatcacatctgccacagcggaaggctttgtgcaggataacatatcattggcttgagaacagagtgagcatgtgtggaagggcctgtaattattaatatgacattggccataatttatcatgtcataccacccacttacagcagcctcatcctatgaaatgctaaatgcctttcttatcaacacttgatgggaaaatgctgttctggcatcttcctctaagggaaacagaaatctaaccatgttccttacagcctagaactctgtacacaaagatcagacttgtttttctccctgaaaatttataggtatttacaaggactcatatcctgtttgctatttagaggggcaatggagtgagaaagaattatgtagcaagtttctttttcttgagatttgctcaagctgctctatgacttaaaaaaactcagatattactccccatttttatgggcagcttgctgttttctattcttgctttcctcaccgactttcttggcaaagctatgcttgagtactcctagcgggtggctagattctcagtgagatgcttctgtcataaaataccctagaaaaggaggttcaattcatgatccagggtgaagtccttgtgttttagtcctattaaattaaagaaccaacttttgctgagtgttccaagactggattctttcttccctgttgtcgtcagctctcagtaggtgcagaccttctgcagaactccgatggcacccatgaaggaagaggaatccactcttatggtatcagagctttatgaaccctttcttaatattagaatggaatcctacagccaagagaaaactgtgtctcacattcaaagaggcagacattggaaggaaaatattcaccttctgacaagttttaaagaaacagaaaatattgcttctttttaaatatttgcctgggtttgatcacttaatattttttaataggtcacaatactgcatttccaggtagatcgactaaaatgcttggagaatggttctgtttaatttatttgcctagttaacttacagcaaaccacaaattatttatttatgtatttatttattttttgagacagtttcactcttgttgcccaggctggagtgcaatggcatgatcttagctcactgcaacttcagcctcccaggttcaagtgattctcttgtctcagcctcctgggtagctgggattacaggcatgtgccaccacgcctggctaattttgtttgtatttttagtagagatgaggtttcgccatgttggccaccttggtcttgaactcctgacatcaggtgatccacctgcctcggcctcccaaagtgctgggattacaggtgtgagccacctcactgggccacaaatttttcatttaacacagttgaatatgatttcatgactaaggttctcattgctgagttatcattcttcagctggagaaggggagagggaaggtgcactgattcccaaagatcccctggcatattgtgaagcaagattgaaagatgtatcctggaaaaaattcattagtttgactctctttttaactgcattcctataaattgagactctactcatttaaggtggttatgagaattgagtggatataatgggatacagagggtggcacattgcaagctttgatgataaattatggatgttatgatatgtatgtactttcatttgtaagtaatgatttttataaaatattatgatacatttctaggctgaccttgaaggagaatactaacataactttggaaaaccaaaaaatgaaaaaagggtatccgtttctcatcatgaataggtttcaaatctcgtatttggagcatttcaatttaagtttgaagaagcaggactgaggtcacatttttctccattggacattctttctgatgaataagtattaaaactgctttgaatttggtttcccccttagataagaaattattttttccatacagtcttttctttgcacctgaaggagcattgagggtgaaaaatagaggcctgtttcctgttcctaactggagccctccaaggttgtcaaactagagcaacaactttgtgggatttatgcctgggacctgtcaaagtagaattatcatagcaaaccctctctgctatcaatcagaggggtattggggatggcaagggcaggcatttttcaaatttctttactgtgcatatttagtcttgtgcctgggggaggaagagctcctttgaacagttcttgtagatttcttttccatcagatggcagctcacaaaactacttaatcttccccaaagggcttctctcattggcctgctgagaaaaacagccaaggaagagagagtgggggaagacagggacaatccaacagcaaatcctagaaaataacgcattgctttcagaggacgtatggtctaagtctggtcacactgatatcatgacttagaaaagcacactgtccattgaaggttatctcccgtcgcttctttttttttttttttttttttttttttttttttttttgagacggagtctcgctctgtcacccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctcccgtcgcttctaagtatcatgtggacatttagcaacagcacaaagctgacagtgctatcatagcggtgtgagtattcttctgtcctccagagccatttcccacatttgtcaagacaaaggttgaaggggaccggacaagggaaatgggtcacccattcattcccatctgtcagaggtttgctttgtcatgataacattcaaggagcatgtttatctatcccgctactggaggttaaggcaagggtaacaagaagagaagaaaccctgtttgaaaagtttacaaatcctgccgtgagggctgtaaacagagtccagccggtggtggagcgtgttaaatactgccacattgatagggacctggttccccggcactagaaatccactcatgtaaacagaggaactgttgctgtgaatcgggtctgttttgacttaaagtctaagaaacacattgccttcaaagtgaattcttaggtgtcacttcccataagttatggcagaagattacaaagctactgatataacatattagtttgatggacagaattatacccccaacgcttcctgctctccccaatgacgcacactaacttagtgtactgtgacagctgccttgatttaccaccagtccgggaggccaaccgggagaaggaacgttcacatggacgcagggcctgagactggcctggagcctagtttataaagctgccctgtaattcaccacaaatgtgtcaccattaaaagaggaaaaaaggattgcagataataaatactctttaatttattagctaacaacaaagagatcagagccagttgtgatgtgattgtttgacataatattgtcaaggaaaaaaaagctaagttgaccagagaggtaaattacacattcaagcagatgcatcaactcttggcttgtcataagcccagctaaacaaaacaccacacagaggggaggactggccaagagcagagccatttatctctgaaagagacatattcaagagcaagtgaaataagacatagttcttttggacttggtcagaggccaggttttaactgttataaattaaatgttttgtgtataggatttggcaattctagttgcctttgtcatggtagggagatgttaggtttttctgcctgtcttaaactcatggtttggtcagctggggtgtgtgtcctactgctagatattggaggatcactaccttttggtaattagcagatattgggaaggtttctgtatgtggcttgtgataaaatcagtggctttagaaaaacttgtaatcgccttcgttttctgcaattcttcctctacagttgttgagcaatactcacacaggtcaccaggcaggaattcatattgatattagactcgtggaacctgaggattggaagaaacatttcatcccgcatcccacccaggacatgcagacagttgtgtatgagcggggcaacttccagggaggccaggcatctgccgtgtgttattgtaacatagctcagagtcaaccagtgctttctgggcttttatttttatataagcgactgcccagcaaaactctcccatcccttgcttgggaaattgagttttcagatctaagtgggtacttttgctttgttttgcatattatgggtctttgggtttagcctattgttagaacagatttctgggttttattcaacagtctggaggcaaggatagagtcctgtgggtaggtttaaggacattgattcatggatcaacatttttttgatgtagttaattgatctgctatgaattgcatctcatttattttatttgttgcaaagcaatatcatgggggatttttgttagatgtcttattgaaatcaatttataatgtttatggtctcactgatctaccagctgaataactgtttctaaaagacagagctagaaggcagggagggagagagagagagagaaagggagtggagaagagagggggagagagagagagagagagagattgatttggcctagctcattctaggtaaaaagatgtactagctcttaaaagttgctactatcttttcaacgtgctcatatatcatatatttaacataattttttacaattttagtgtcattatttttagaatcttctgttcctcctttaaaaaatcaacaaaaatatttgcccaaatttgctttttatctgtattttttcaaatattagtaacattgtttccatgagcagatctataagaatttttttgttgttgctattgtaaaataagatactatttgtataggtctagacaccaggcatctcctatgtctcataagctctctagggcctcattcttccatttcttttttcttttttacttttcactcatcagtctagcccaaggatataatttcatgatggagaaaataatgacaaaacaagagcttagttttaatcattctgcctttcctctgtcatttgggatttctttttttaacaaccattttccaacagtagacttattttcttcctttgagcatggttttcataagtgacttcttaaaatctgaattcactagaatatgccccatacagttatactagtttggtttctttcactgcttccctatcctcaagcttccccaaccttccttccttgttgtcaatattcataattatatactcagaatttcacttttagtagcatccttccttcttgaatttcatgtcctattaggatcaatatctgtggaaattactatactatactatactataccataccataccataccataccataccataccataccatcctatcctatcctatcctatgctatgctatgctatgctatgctatgctatgctatgctatgctatgctatgctatactatactatactgaaatgctatagtctcttaaaaataaagcaaatccaatcaagagtattcatatatttgtgttccaaaatatgcaaagttatctccaattaggcacggtcactttctcctaggggtctcatatcttccataccaccaatctttttattttttaagtttgatcatgttggcatttgttctgctatataatgtatattatgttgctactttttgaatatgttcactaaatgcacttctgcctgattttcctggtttccaaaaaggattttccctcttcacctcttctcctctcctctctctctattggaaatacctttcttttcagcaaggtgttctcttccactgtcacattctgggcatgattacccaccaccgtgagtttagttcaagttcattttattttagaagttacgaccggttttataggaacaatgtgcctttatcatgtcaactccatgttgaaaaacctttagggcctcctcctcgcatttgggttacagccacaaacccttagcctggcttctgaggtccacttaaccttgaactcaatgtacttttttggcctaaccttccagactttccctattttcactcagcctttcaaatcaactgatctgctcatagccagcaacatgatttgttcttttattcgttcacctctttgggctttccccccagaccttttctagttttcttaattagaaagtgagtcaccaaaaaggtcattaacatcaagtctttcattgccttttgtttttttctctatgaagaataaaataattttatggtgcaaaatgaacttttgaaggctaagaaagaacataaagtttgggccaaccaaaattaaaagtgactcacaattaatactaccaaagaaggcaatcttccgctgtccttaagtcagcaaggatttatgagagtgcttgatgattgtgtgttgcatttcctctgttggaaatgatacctagaattttagaagcatagattctgaaggatgacttcataataaggattttaggagcccactgttacccatctcaaccttggatgcctgaaatacactgacattcctacacatggctacatatcattcttattattcagtccacagccattgccaggatagataaaaagcaactgtcatttcacatcagaccaagctaggaaagtatatctttcctcaaccaagaagatggagtatgaaccagaccacatggcccagtggatgggaattgatagtgcatacagtagctttaaagcagcatggagcaaaatagatttaaatcattccgaaagaaataaatcctaacaatggatacattgtgctgaatgaaatgaagctcacaaaagaattgattaggaagtataccaaatggaataaaatgtagcagaaaggcacatattagagagaataaaatatgtttcagtctgaaggggatttaatttactaagatacaactgaccagctataaagcagatgaataacatatgtagtcaagtcaaatggacattcaatggaaataggtttatatagatcaatggcatcatgtgaccagtttcattcttctaattctatggctcattgtgtaatatctttagctctctcaagaaaatctgaggcttttcctgaatcctgaaagagggaactcaccttaaaggagtgtatgattaattggaaataggttattgtttgttggcttgtcttggtccagagaaccataataattttctggaattagaaggattttacagtaaattgcaatagagtatcacagtgaagactatttaagcactttttcctccaatgttaagttagttctactggtcactgtgctgaaatacttagagccatcaatggtcttcatttctctttctaggaaacttggaaattttaggtcaatattgaaattatcttgctgggaattttctcccacatgcaaacatattcattaaacactctgttgtgcttcagtcggagtcctttggagaatgtaattctcaacatgaatgaagcttatttccagcgttattcacagtggcatatcaagggcaggggggaagacagtggtctgctccaggtacagacaatgaggggatgcattgtttgtagaaagttttaaaacaataataaaaccaactaaaattttgtgtatattctgttatcaccatgaactggcaattcaggcaattaaagtgataaaaatactcatctctggaaaaaagctgtcaatctaagttctaagtaattgccaggagttctgttgtattttaaaataatgactattattgttaatatttattacattttaacacacttaaaagtttatcttttaagacacatcgtattctatatggagttactctggggaactcctagctctccaggaagccttagcatacatgaacttagctgtaaattcacagtggtttggaatattagagatcacatcacagtcagtgtctctaaaaccttggtagcatatatttctgcatttgaacaatatatttgaactaggcagtcgtagaaaaatgattgagagataaagaaacaggtcttgagttagttctgtcattcaatgagactacttggagcatttacttgtttttaatatttaaaacaataaaataaaatacaaaccatgaagtgtactattttgtctttggtaagtgcaaatttaagtttatgcatgaagatctctaatatatttgaataatagctttacattaaaaatttaattttctttttaattgttaattatttcaaaacaaaagcaaattaaaaaaataataattactaattacgtgcttataactgaaaagaattttgttttatggaggaaggggtattaataattatctgctctgggtatcaaatatgctagctatggcactgggtattttctttttcttttttttttttttgagacaaagtctcactcttgttgcccaggctggagtgcaatggcatgatctcagctcactgcaacctctggctcccaggtttaagcaattctcctgcctcagcctcctgagtagctgggattacaggcacccaccaccacacctggctaatttttgtatttttagtagagacggagtttcaccatgttggccaggctggtctcgaactcctgacctcaggtgatccacctacctcagcctcccaaagtgctgggattacaggtgtgagccacggcacctggccagcactgggtatttttatttttattttggttacagatgataaaacaattcaaattgctgaaaaaatatgtaatttaatactttatcaatttccttttatcttgcaacaaaccacctcgaaatttaatggcttaaaataagagttatatataaggtcacagtcctgtgggttggctgggtgcttcttatctggactgacttggttggggctggatggtcacaaatggcctcacatgtctggggctcagttgagatggctggaatagctttccatgtgatctctcttcttccagaaagctagcctgggcatgttacctggtgggagaaaggttcccttaacaggagaaggaaaactccatgctcaagtaccttttaggcatttccttgtataacatttgttaatgactcattggacaaaacttgttacatggccaagtccacatacgaggggtggagaaccagactctacctcttgatggtaaagcagtaaggttacattgcccagggaagtatgtatagaggtaaaagaaatttttgcagccttttttgtgaataatctaccacctacccataagggttgtgttatctccaggtattcaagtaacattggcagtaatttccatcttcatacttcgtctcagttctacttttttatgtagttcatgtagcctttttaaattaaatgtattttttttacttggcatataatacttgtacatatttatgggatacctagtgatgtttcaatacatataatgtattgcatgatctgatcagtgtaattagcatatccctcatcgcaaacatttttcatttctttatgttgggaacattcaatatccttcttctagctactgggaatgatataatatattattgttaactgtaatcatcctacaatgtttttttaacatgagaaattattcctcttatctggctgtaatttttcatcctttaacaaatctccctaaccctctctttgctttacccttcccagcctcttgtatcatctcttccacttttcatttctatgagatcatctttttttagcttccacaatatgagtgagaacatgtggtgtttagttagttctgttcctgacttatttcgcttaacataatatcctccagttttatccatgttgccgtgaatgacaggatttaatttatttttatggctgagtgatattccattgtgtgtatatatatcacattttctttatctactattccgttgttggatacctaggctgagtccatatcttggctattgtgaatagtgctgcaataaatatgggagtgcagatgtctttttgatatgatgatttcctttcctttatatacattcttagtagaaggatttctggatcatatggcagttttatttgtagtttttaaggaacctcgatactgttctccatagtggctgtacaaatttacattcccaccaacagtgtaaagagttcctttttttctctatcctcaccaacatttgttattttttatctttttgataatggccattctaaatggggtgagatgctatctcattggtgttttgatttacgtttccttgatgattagtgatgttgggtatttgaaaatatatttcttggccattcgtatgtcttcttttgagcaatgtctgtttagatcatttgcctattttcattcttaattttttccttcactcattggttgttcaggagtatgttgtttaatttccatatattcatacagtttccagcattccttttgttattgacttctagttttattctattgtcatctgagaagatgcttgatataattttgacttatcaaaatttgttgagacttgttttgtggtgtaacatatggtctatcctggagaatgttgcatctgctgataataatgtgtattctgtagctgttggctgaaatgttacctacatgtctgttaagtccatttggtctctggtgcagtttaattccagcatttctttgttgattttctttctagatgatctgtccaatgctgagagtaaggtgttgaagtccccaactactattgtattggggtctatctctccctttagatctaataatatttgttacatatatatatatgtatatatcagtgttctggtgttgggtgcatatatatttacagttcttatattctcttgcttaattgatccctttgttatcatataatatccttctttatctctttttagaactttttacctgaagtctgttttgtctgatataagtgtagctacttatgcttgcttttggtttctctttgtgtgggatatctttttccatcccttcagttcaagtctacatatgtctttacatgtgaggtgagtttcttgtcaacagcatataattggatcttttttttttaaacccattcatcctgtctatgttttttaattggagaatttaatccatttacatacaaggttattactgataggtgaggacttactcttgtcattttattcgttgtttcctggttgtttggtatattttgttctttacttcctctcttattatttaattttggacttagatgttccctgtagtgataggtttctcttcttcttttgtgtattgccttgcttcttttctctttcttccttgtgtattgtccctaccagtgagttttatagccattttttgcatgttttcatgatgatgatgaagattttccagatgtaaggcttccttgagcatttcttgtaaggccaatctagtggtgatgaatccacttagttttagcttgtctgaaaaagattttatttcttcttaatttctaaaggatagctttgctaggtataatattcttggctgacatttttttttcttttagtactttgaatatgtcatcccattctctcttggcctataaggtttctgcggagaaacccattattaatgtaatgagagttcccttatatgtgacttgatgcttttctcttgctgtttttaggattcaatctttgactttgacttttgacaatttgagtataatgtgcctccaagagaacctgtttggggtgactctatttggagttccttgatcttcctggatctggatgtctatctttcttccaagacttggaaagttttcagctattactttattaactatgttttctgcacccttttccttctctgaaatatatgaactacacaaattcatatgccatccttgtgcaggggccatgctaatcttctctgtatcattataatttgagtataggtaccactgaagtgagcatttttaagaaataaattttgataagatggccaatatcagcaaatggattacttcttgccagcttagcaaccctactggaaagagagcttgttccaatagttcaagacaaaatttcaagactgacttttattggctggattgacttgcgtttcttttcttttcttttttttttttttttttgagacggagtctcgctctgttgcccaggctggaatgcagtggtgcgatctcagctaactgcaaactccacctcctgggttcacgccattctcctgcctcagcctcccaagtagctgggactacaggcgcctgccaccacgcccggataatttttttttttctgtattttttagtagagacggggtttcaccatattagccagaatggtctccatctcctgacctcgtgatctgcctgcctcggcctcccaaagtgctgggattacaggcgtgagctactgcgcccggctggcttgcgtttcaatctaagctaatcacctgggtcagacccacacctcgtaccaggaactgggctcatgtccatcagaatcatatgaaatgaaaggtggaaggcactggttctaaaaaaaaaatgacaccctagttgttacaaaatgaacagtgaattaatgctgggcatgcaaaaataagagcctttgactaccctcttgtgcttaggtcatagtatcaaggagataactagatttaggctttcctacttaggtttattgttatttaaactcacttctcataagccttgaaaagcaacacacatgccttcaataatgggtctgcaagttgaactttaaatatttgctttacatattttttgaaagtcacatgtgcaaacatttttatatacatacttacaaaggtagataacatttctgcaggatgaacccgtcatataaactcattgatgtgccacatgtgcacaataggtggattatgactaaaaaacaaatttagaatgacatttgagcaatcttgataagtttatggagttgttggagaaggaaaaatattagtggggaagaaaattgttggcaataaaattagaaaacgagcctcatgtaatcccagctacttgaatggctgaggtgggaggatctcttgaggttaggaattcaaggccaccctgggcaacaaaacaagaccccatctctaaaaaaaaataataataataaattaatcagatgtggtggtatacactggtagtcccagctacccaggaggtggaggtgggaggatcacttgagcctaggagttcaagctatgtgcatgccactgtacttcagcctggacaacaacgtgagactccatttcttaaagtaaaccaaaagccttcaaatgcatataacctaaaatcaggaatcaccggggttctcagtgattgaaatctttaccaccagtgttcactcatgctagcctcatactcccagcctgctccactcatgtacgcgcttctcatcaacatgctttattttctgaatgattctccgtgaaaagaacaaagtggggtgatggaaagtatagtcacttggcattcaggtttaggttctggctccggcaccgtgtgaagtttatgagtcttttcccatttctgggtctcagcttcatcttctgtcaagtgaaagattagggtaactgatctcaaataactctctggcatatatgtgttcggcacctacatcttctctgattggtcctgggttattcaacatctttcctctgcaacttatttagccctaggtttggggaatgggcactaacttctcctgtacagattctttcccaagcttccaaatccatggcctttagttttgaggttctgctggcccctgtttttttccccaaagcaaaccctcttgacaaattcatgctttccagcaagcttaccagggtaagtcatgctggccagggtgacttgtgacactctgtttccacagctggctctggcctgtgcctgactgctgctgtgtctgattgttaccagccatttgccctttcttaagcccttgctaaccattttctttacagaatatatatgttatgtgccctagcataatttttctcataatgaaatagaatcattttcatagaactttgcaatgttgttaacattagcattttggggaaagtcttctttatagttgtttataatctcattttcaaattgaaaaaaaattcaaatgctatttttagaaggatacattccaaacattaaatgattgatctttactttggaaggtacctcttgggtcaccttttcatctctagggagttgattccaaggcaaacttgtttctgatgaagtgtttcaatatgctttattataatctgggaccacaaaaggaacttctaacaaacttttttttttaaaaaaagatcatctgtttatctcattctctctctttcttatgcttttgcaaaaactttttatcagtttacagcaatatgaaattcaaagaaaaatcaaaatagaaaaaaactctccagtttgaaaaatggagttgatgtgctattttaatttggtgatgattctactgaggcattgtttccaggtttgcatgatggttactttatcttttttgccttttagactcaataagatatttctccatagcacattactcaagcttctacataactcatctcacatagttacgaagttttgtccccttggactgtaagcccaggcagggatgggagcttgttcattcttggatccctaccgtcttgcatagtgcttgctatgtagaaagcactcataggctcaagtggaagaatactgtgtaggagcaagaataatatgtaggggtaaaatgttgaacatgcataaatattgaaacaaagaaataaattgattttggtgataggtgaccctgagagggataaaagtgtaacccagaggccctcctatgttacagtggcaaaacctctgtcaactctgatgtcttctgctacaggttaaacaagaatggaaagctctattcaaccatctaaaactctgccttcataataatgatggatttgctgtcatcataactcattcgtaggtaatcttgcaagagctgaactttggaactactgccatttggaagggttccattcactctaagggaaacctgagaatctgagttcatttactttttattcccccttttagcagtaatttgttcatttacctttaatgttgaaaggaagcaggttgaggccagccatgatggctcacacctgtaatcccaacactttgggaggccgagaccggcagatcacttgaggccaggagttcaagaccagcctggccaacatagcaaaacactgtctctaccaaaaatgcaaaaaattagtcaggcatggtggtacatgcctgtagtctgtagtcccagctacttgggaggctgaggcatgagaatttcttgaacccaggaggcagaggttgcagtgagctgagattgtaccactacactccagcctgggtaacagagcaagactctgtctcaaaaaaaaaaaaaaaaaaaaaaaaaaaaaaaaaaaaaaaaaaaaaaaaaaacacggaagcagattgaaataatgtgttttccatttgcaagtggcatggtcattttagttgaaggcatgtccactgcgagtatttcggtcagcttggctgcttctcatgctgtttgcccaattcagcactacagattttgctctcttaaattccagctttatcccataggagaggtgcagatttctatttctcatctctcgtctgttttaattctttgggagaggagtcctgagtactaaacagaaaggtacgcatggagaaatgtaaaacatattttcaggcacctttgtgaaaggaaaatttaatgggacattatagtactatgggaaatggagagagataagaatcatgccccatgcttaaccttttggactcatctttgccaatttctatgtgcagttcagtaaattaaataagctttccttagcctgaaactgtctgtgatagtgcaacctttcactgaggtatcacagacagacattcagcgttcaagacaggggcctgacacctttcaaaagtgaaggaacctgtggcaattttaaacattccaaccatattaattccagtgacagttatcctctaagttatttgaaatggattctccctcttcaactttcgaaacttatatttgatccccatggcctctggggcctgcacaggggcactctctgtgactgagtgcgtgaacagcaggaggcagaagcaggaaattgttgatccggtccgtttatgtctttcctcctcctttagctgttctctgtaccttattcatgtttctaaggaaaagccttgcatttccaaaagaagggttgaataacggtttggagttctttctttgagggcaatgtttttattattgctcttccacccaggctgaaagttgagtgtcatctctcaagcataagcaactaggcacttcacaatcaatactgggctcagtggttgagccctggttaatagagctgcttcttttcaggtgctcacactcagcgcagccgaattctgccttctctgtcctgggaggacacagggacctgtgcccttctccaacagtgggatcattctcgggaagtgctcctcactttccacatggtcaggaagttttggatgtctataacaagcacaggcgaggcttggtatggagcccagtgtttatacttaagagagtgctgggggaatggtcacagaagacccatcaggcccttatgggctgagttccaaggtgactgtacattggttattgttggggaagagtcagatcttcagctttccatgtgtgttggtttgatgttattactagtcatccatgtgttagaaatgaccttattagttcatgtctaagaaactaatttacaaaccaaaagactaacatgttatttccatttgggtgagggatagtattcaggaaaccaccagactgttcacatttgcattctagggacctcccttcctggtattagactaactggcaaagtaaattaatcatctgcaagatttctaagtgagaatggatgattgcatagctgttaaggttacaagtcaaatagcctgtgtttggaatcctggccatcacccttaatccctacatgatctcagaccagttacttaccctctttaagccttgattaactgatctagaaaatgagatactaagagtacttacctcatagagttgttgggaggattaaccgggataataaaaaagtgtgtatgaaaatgcttggcatataataagtacacaataaatattcacactagtattagtagtataataataatcatctttttttgtaataaaggtaattggatatgttcctaggccatttcatcctataatgttagaatctggagacttacacctgcttctccatagaatactcctttgcaaggacaggattacctgttagctgctagaggaaggctgacaatttcttatttatcaactcttctttctctagatcctgtgttgcttttttgtgtttatgaatacatatttaactactgtttatagaatatttgctatatgccgtaatattgtgctcttcatcatattacctaatttagttcttgcaatacctgtttgaggaaagagtcattatctccatttttcacaataggaaactaagtacagagaagtaagaaaagcgaggaggtagaacagctggggcttcagcttaggtctgtctactaaattccatgtctatgacactaggctatcctgcatctttatttataactcagtatattagaccttgagttaattagattattactaattttatatttattacaaagtggcatttttgatgagttttgagaaatgccctagtatatttacatacattgaatggatgacaatttgaaacttaatttcaaaatttcacaagttagaatttaaaaactagacttgtaacaggagatgagtttgttttgattccggagaacattcaatctctgggtgatgatccaattaatataggctagagtttcccaggtagatcttatgggaaaatgatacaggagggacacattatcaagagtgctgataaattcaaattgtaactaacctcccttagatagacccaagatagtcatgcctccttctatagggactctttggggcatgatagaccagatgccatgataaagaatggcattcccacagttgagatgaatttccacaggtcaccatatgcagcttcctttctcagcaagaatatccttaactttatgcacataatttttttttgttttttttaaacagctattttgaggtataattcacatactatattgtttgcccattcaaattatataattcaacaatttttgacatattacactacaacttttaaaattgtggtaaaaatatatataaaaaatttaccatttaaacttgtaagcataaaattcagtggcattaatgatattcaaagtgttgtgcgaccatcacaactatttatttccaaacccttttttatcactccagtagaaactctataattattaagcaataactccctatttctccactttccagccctggtaacctctattctatttctgcctctatgaatttgcctgtctgcttcatgtaagtggaatcatgcaatatctgtccttttatgcctagcttatagacataaaccttgaaaacaagatttatctatgtggaagcctatttcagaaatacattccttttgatggctgaataatattccattgtaaacataatattctggaatgaagatgtggattccatctatagctgtcaatcttgtgagtaaaatcaccagttttgtgtgaaatgtctcatttgacacaaccaacttggaaaacatgttgaggatatttctagaatggtacccaatctattgacccttgtattattatttattcggtgtttttcttgaaatcagttcacttttaaatgtcttaaatatttatcttattttgtcctaattaatgttcatgaagtccataggttgacgtaatattacatattgctattaaaatgatttacatatatttgttctgtatacctcctaaaatgtatcttctacctcagccacatataggctgtcaataacttctctaattctcaaacttgaggggtgggctgtgtgtcagaacatactagagtgccagattccctatggaacagaaatgaagaggagaggaattgtaacaaatataacctggtgtgaaggccaaggttaaccctaacccaaaccctaaccctgggagtcaattagtaggttcaagtctgggctaaaactgcttctaatcagctgtgtgatcttgacacatagtcctctgtgccttagtttcctctctgtcttaagcaggttgaagtagatcatctcctcctgttgctcattcctggatgtcctgcttctctcccacattcaggaatgacagggctagtgtgtgcttctgcacttgccctccatggggctgtactggagggatttccatttctttggcttcatggtatttacacctctctcttttcacttctctcacccctcttatattagatcaaactcgatctgatgtaactcttaatgatttcctttttaaggaggacattaggaaagcctgcatcaaggacatcacttaccttcatttagaactgtgggcatctgcactgtgtccatttcttacagcgataaaatggcagtaaatcagaaaaaatgccatgcccttcagaaccttgagaatgagctcctgagcattctgcttacggggatgtaggcttgtcagtgagtaaatcagctctgtccttacgcccccattgcatcagggaaatctctgactttgtgggataggtttgacgtgtcagtcaatctctctctacccccatttgagactgagagtgtatctctcctgtgttttctctgagcgtgtttagtgagcttattggccccctaggtttcattgccagccacagcttagtccttgtcagagagattattatatgaaccctaggtgacttctgactgcagaagggccctggatttacatttttgcattccaaagtcaggaatataaatgactaatggaacactgggccaccgaatatttatatatctattttgaaatttacatttctccctttcttatgatggggtttgctgctcccggggtcgtagttcatgggccagtagcatccgtggtgacaaagcaatcatctggggagagtgcttcccagccccagtggcacactgtgatgtgctgcaggttattatgccagcaattcagcagtaatcgaaccccccatctccttggccctatccctgcttcccttttatgatgtccaataaattttacatgctccaatttgcctcatccaccacctaatactgtttgaattaagaatctcttccatagctttcaacaatgggaactttgctttctccaaaattatttataaaggccactcatgactgtgccagaacggaggctggactgtgcaggtagagacagtgcacatatgctggtccatatagaagatggggttgcccagttgttgaacttgctgactacatgatatattgagatggaagaggatgtctatagatacatactatatctatatgtatgtatgttttgaatgaaaaaattgtgttaaattaggaattttttaaaaggtagagcatccatttgaaagttccctggtccctgatacttttcacgatatatggtacatttaataatagcagtaacaacaataatagcaacactacttaagcgtttactactcgctgaattattctaagccctttgcatgcattttaaaattccaacagccccatgagattgagcctttttgtaaacctgcttataaaggtggaaataagttcagagaggttaagttcctcaagattacatagctagtaagcaacagggctaggactagatgttgtattgtctgatacctgtttttaacatcacctaataccaccatgtggtgtaggcaggaagcagagatcttgagatgaatgttagtacatttctcattcactcaagccactcaccttttctcattcactcaagccactcccctttttgttccccgtcagtatttacaaagcatctattctgtgcacaccctgttctgaacactgggtatcaatacagcagtgaagatgacccgcagtccctactcttgtggagttaatattttaatacttgtagtcagacaatagacacgtaaagaaataaaccatgcactttctaacattggtgtctcaaagaaaatgcatgagagcaacgcaatggaaagtgtccagttggggaggggagctattttcactaggatgccaacaaaggcttccctgaagactgggcatttgagctgagacctaaatgtgaagatggctgggagctggtgtatggagcatagggttcgctagaggaaaggcagctgtaaagacccaagtcaggaatcagtgtcttgtgttggaaagccaggaggaagaccagagtggctgaagcattattagctgtagagagagagtagattatgaagtcaggagattggcagacctcaaggcgtgcagagcagggcagggagtgtggatgccgtggtgttttcagttctttcaatcaatattttactgcctgcagcccattttcttttacagcctgtcttcttttccttctgctttgactcgagtcttacctcataatgggcattttaatcctctctgtgatgcaatccaatgcttcttgctgggcaccttgctttattccagctcagggcagcattaaaaaagaacagaggaagtctccagccgagaggggctcaggaaggggtgcaggttgcaatctaagagctttaattaaatcaatgccgtgcacatcctgtccacaaagctgggggcaattgcatgctctttactgacgccatgatatacacttaagagctgtgtgacttcacagaagcaattaaattggcctgtttaatcagtggtaaggccaccatcaataacaattattatttttattgatttgataagtgcacagtagaaataatcacagagaatagctgtctctttccccctgtcctttgcctaaatgctaaaccctaggctacccaggccaaatctatagtgacctcttgaacagttttactacagatccatatgtaatcaagaattcctaccttggctaggcggctcacgcctgtaatcccagtactttgggaggccgaggtgggtgaactgcattaactcaggagttcgaggccagcctgagccacatggcaaaactccatttctacaaaaagtacaaaaattagctgggtgtggtggcatgcacctgtaatcccagctacttgggaggctgaggtgggaggatcacttgagcctgggaggtagaggttgcagtaagtcaagatcatgccactgcactccagcctgggcagcagagttagaccctgtcttggaaaaaaaaaaaattcctaccttataaaatttccatgctaaaaaaaaataatccatgctttttcattgaaacagaaattttcaactttccagtcctttgattggtaacaaaggaatgctccctatggcaaataattaaatctgcattttctctttcagcctcatccatcttgtttattgttttcctatagctcaaactatgatctcattttggccagaaatataggttcagtgacagaaaacaggcttggacattgcatagctgtggatatatacacgattatgtggatgttacagaacctaaaggaagatctaaatggcattataagaagctgcttttaccccaagacttattatctttctccatctcacttatagtttagcatctttgcatttgtagttccaaaaatctgaattacttcccctcgccttcttgtgaattaattccatatacttgtgaccatgggagagaagcagactcaaagtataccaaaattggagtccagccttggggaatgaaagagtgaacctttgttcagggagaaagaaggggccctgatttatgtgtgcagtcactcagtaagaaaagctaaaatgtgtatgggctacatccctctccactatcccactgtgagagatccatgaaggaatagggagggattgttggtcttccatggtacttctcctggaggatagcatatgttattcccacctgacttcattaaaggtaaaggtctcaggaatcttgaatgacaatcacagagatgcccccattccaccattcaccttggatttttggccaggttggcttcctgggggaagagggttacaatttgtctactaatatatggacacattggtaaactgaatttaaatcctcctcaatggacttgatgccacatgggacttgtatggggcattgctctcacagttctcattcaagagctgctttgtttccagatagttctacagctcttcaatagaacctggaatccatggtctgtgaggagaaacagtgacccaggttgtgtcagatgtttttatacgtaccatgaatggcttctgacatcacaaaggtttggaaaatgcattaaattcggtttacctcttaggcattaacaagatacattagcatgagggctttgagattctagaataatttctcagcattttccaaacagactcagtcaaggaaccctttgtcagagtaggcctattccccagaatatacattggaaaagctggtctggaggcctgtattagtttgttctcacactgctataaagatactacctgagtctgggtaatttataaagaaaggaggtttaattgactcacagttccacatggctgaggaggcctgaggaaacttacaatcacggtggaaggcaaaggagaagcgacacacaacttacatggcagggagagagagcaaagggggaactgccaaaaacttttaaatccatcaactcttacgagaactcactcactatcatgagaacagcatggaggaaactgcccccatgatccagtcacctcccaccgggtccctccttcaacatgtggggattacaattcaagatgcgatttgggtggggacacagagccaaaccatatcaaggactaaccacttatttttttttcttgtaggcttgcatatgtacctatacatggggtgagcatcctctcacttagggcaaaatttttagtgaggaattctatgacagtgctacatatattgtatatatgatatccctgttcccaaatgtaaacatctccacatgtatcccttctagaccaaaacctttttatctggcttcatggaaagctgtagtgttttgggctagtatttaccattagatctaaaaacggtgcatccttggattccttttgttgaattttgtgtaaatatttagggtatttacaccttgacaaccaatgactttaaagtttaaaaactgatatttaactgacttttatacttactaatatcacattatagatgctaaagaatcattgtaaccattagacaccaacgatttctttcagagtttgttaaaatcacgttgccttttttactatttttaaatagtatgatatctaatctgttcattgcttgtgtgtaagtttcctaaactttgccatacctccatataacttgtactattatgtacccagtatgtgtgacagggttccctgatggcaatctccaaagaaatacaatttgggcataaagtaatggtgcctaaattctgcccagaaatgttctgaaatgggggatagggttgaggtgacatgtagttccctctccagaagcaggggagtggaggcaggctcctgtgtcctccagtatgtttcccatccagtatccctggatcaggtgaatgaaaagggcattaactaatggggatattacaggatgaggtcaaatgatccatgtagagttcataccagagtacctgccatataggaaatatccaagtaattctattgttgtcatggttttattgtcttcaaatatctttattttcttttatggatttttacatactacctttttttagacagagcaggatttacttttttttagacaaagcaggatatatatttctaaacatttgaagatatttgaaggtatttgtcatcatcacttagtatcccaggtatcccaaccattccatcttaatagtatctgagtcattcatagtatatcctagactgtttcaggatcaccagttccaaatattggagtaagttattaaacaagtcttttaagatcttatgaagatcttaaaatagaccaggaagagaagtatacttgcccatatttcctccatttagttaatcccatctaaacttgctgcacataaattggaagaattaaataaatgagttgtgaaaatggtgtttttaccatcaaattagatatggatcatctggctataatgggcctggggcacaatctatgcatattcatttgaaaaccaactgggatgtttaaaaaagtgagcaggtcaataagaatacaatgatttctgtagactggtaatgcatggccaggcattaaaagtggatattgtatgcatctgtgtgtgtgtcttggaaaagtcaagtagaacttgatttgggtaaaacccaaatgtttctgtgttctttctagtcagttagttattttgtttagttagaacatagtaccactgaggtaaaggttacgtattttattcttgtgagagctgctttgctatgtatcagggcaaaaaaagaatgatggaacatctctactttttataaaaattagatcaacaatcactgtaatggtagaaaaagagagtatatgtgttttgatattggagcggtttttacaaaaatcatatatgtcaattttacacaggatcactcactgcttttctgctctgaaggatgaagatcacaactttccctaccattcccctacctctcaatttttgttagttacattgttatcattatattgttaatgacaattgcattctcctctataacaatgctttccatagttgtttagtgttggctccatatttaagtgaactcagagctcagtggaagttctttggatgatagctctccactcctgaattcttactccagccctaactggctgggctttcttctatctttttcaaaaagggctcatgaggcctgaatttcttaagttccatgcttgttgtatttgaatgatattttagttgggtataatagttttaggctatatatgatttacatatatatagaaatatttcttcattgtttccttgtattgaatgtgattctggataagtatgaggtcagactgacttttcttccttgtaggagattcttttttcttccatctggttgtctagagatttttttcccctgaattttagtaacttaattaagatttatttgattgttcttcattctttgtatcatttttttaacttgctaaactcttttgaactatatttttttcttcattttggggacttttttaagtatatgtttgaatatattttctgtcacattaattgtacacatacaaatattactgtctttatttcctatgagtcttaaattatctaattattttattttatttttcatatgcattcactgtgattatgtcaaactgttgctctgtcagtaatttgatttttagtgtgacccctctgctctttgatctttccaaattgctttttacttctgaaccatattgctttggtctttgtttctttaggtcttctttttaaatccattaaattgtgtgtgtgttggttttttgtttcatcctatttgtagttggctgaggttcttgatgaaaaaattttgcagtagatttggtgagtttttgcacagtatttctttaaatacttttccttcacaacctcttcctcttctctttatattaacaccatatacatatatgttagatcttttcatattgttccacaggtccttgaggctgtattcattatcattgttttcctgttttccaggttggataatttatttttatgtatcttcaagttcactaaatctctcctccgttatcttcattctgttattgagacaatctagtgaatctatctatctatctatctatctatctatctatctatctatctatctctttctttctctctttctttctctctctttctttctttcttttgttaattcttttgttcattctgtctttctttcgttctgtatttctgtttttgctgttgttgttgagaatgggtctcctgttcacccaggctggagtgcagtgatgcaatcgcggctaactgtagccttgaactcttgggcttaaagatcctcctgccttggcctccctagtagctgggtctacaagcatgtgccactatgtccagctaatttttttttttcttttttgcagtgatggggtcttgctctgttgtccagactggtctcaagcccctgggctcaagtgatcctcccaccttggcctctcaaagtgtcaggattacaaacatgagccactgcacctggcctctagtgaattttttgtttcacatgctgcatttttcagatctaaaatttctaagttttttatagcttttgtatctttcctgagagcttctacttttctactaatttaaagcaagctcaactttatctcatggactatgcagctataataggtgctttgatgtgtttatttgctaattccaacatctgagccatatatgtggattattttttttacacaaatgtgactaatacttatttgtatatttagtaatttttggcttgtatcctgggcattttgaacattatgttgcttcaatattggatatattacaactctgtgaagaatattaatatttacttttttgttttatgaagaattagcctcatttctttcagactatgggttctgtcttgcctttcgtgggttccaatcttggtccagttttcaaagcctttgacatcctcctcttgatctgtctgtgcctgtacactcaagagttagtatgaaacctggatggtggtttacgatcctcattccgttctcagagcccttgctaatctgctttggatatgtcccgcacatccaaatgcacagctcagagatgagctgggaacttgtgtagtttcatatacagaattagagtatccccttctccagctctctcactctgggattccctccacaccttccagtccttaagggctgtttttcacagctcttcagcccagaaatttgaaatagaaatagaaagtggagtttgagatttccatggtactgctgtatcagacgactctgtgattggggcctgcatttggggaaaagccacattaaaaaagaacaataaacccagaaattcacctcttggtgggtagcttctccataagccactggcttttgttttacttttccccatcctcagtatccttgtattttgtgcagtgtttagttgtaatcagtggaagagataggaggtagtgggcttaccctctcatgcaagaggcaggctcacattcaattaaactgcattcagctgagcccctcttttattaaagtcttgttcttactaagttgttttatagcataaagctatttggatttttttttctgctgttcctttagttgttgggtcctttttgtgtcttttgcatgatgtgcttctgtcctccttttcctggttttgttgttagtctgaattttttgctgtgctgtttgttttctctctgatcatgtttgagtaactctgaaatatacagtgtgaatggcttcttaattatcttcccacctctcataatatgagcttcttttaccctcaaagttgcagtttgagaagtaagtatttcatgttttgtccatgttctgtagcttcagaaaatggggtagggaggagaatagttcaactgagaagggatgtgatctttattggaatagccagacttaattctctcatctgacattctgttaaaccttcattagggtttacttttgggctttggatgatttctctaattcactgggtcatcatggaattttcatgcccattagagggtgtacccagttgttagttttctgtgtttcatttgcttttcccagtggttacttaatccattactcagtcagaagaaggagaagagaagaatgcctagataaagtttgcttctttctagatttggatgcattaatgagaatttttcggattttgcagattccctgtataatttctggcactgtctgggatgagctgtactatacctccagttaaccctagagtcttctggctccttcattgaattccagtttctaaatctgtgctcatgtgtttacccaactcaaagtagatagcttttctcaaatcaggaaaatgtatccctgaaaagtgaagtgttcctcggcaggtttggtcattactgaatcttccgtaagaaattctttaaaaatataatgagataatgactgtgaaagtgctttataaactataaagtgctcaacgcatgtaaaactgtgatattatcatcactcatgtcccctatgctgctaatcgtcagtggatcagccagggaggcaggcgttcctcgcttctgctttgttatactgtcttatcccgaccttgacactctggcagcagtgaccctcaacaagataacctgacagtcagcggtgtctcacccacactattacctgcctttgttagtagcactcagacagcatataggtaattccccatgtttcttgttcattgtctctgtaataaaacattttcttttatagaaatcctgactctaatttcacaaaagctctgctatggaacctcctctggcctctcccttcctcctgaaatacagtagtgtgtgtttcatatttgaactcacaagctaattgaactttattgaaagattcttttactttgcccaacatctttaaatagtgatttggtgctatgattagatacactctcaaaaactattgttgctgggtagagagaagcttcaaggaagaatgaaataaacaagcatgatggagttggatgggttagaacaagtttgtttttcttatgtggatatgcttttcatatccacatttattttgtttccttgtctgaactgcaaggtccttggggataggaataatgactgactcagactgttctggaaaaatggagtatgatggaggacatgagcaatacctataatattataaatgagagaaataaaatgataaggaattgctgaccaaatacagtaacactaaattgcagtgattaagagcatgaacttagagtttgaccaattatagctgtatgaccttggacaagttacttaacctttctaggtcacatctgtgatttggagataataagaatatttgcctcctaaggctgttgataacgaatgtaaagtgtttatagcagtgcctggaacataatacaggcaaaaatgttatctgttatcatcatcatcatcattattcttttatgaattcttccttgaagcttcacaaggcaagtacaggacaaatgaaaagaaataaagtttacacagcatgggataagaatatgagatttactatgccaaaagtggtatagacgggctaaggattaaaaactaataacaaatgcttctttttttttttttttttttttttgagatggagtttcgctcttgttgcccaggctggagtgcaatggcacgatcttggctcactgcaaccgctgcctcccgggttcaagcgattctcctgcctcagcctcctgagtagctgggattacaggtgcccaccaccatacccagctaattttttgtatttttagtagagacagggtttcaccatgttggccagtctggtcttgaactcctgatctcagaataaatgcttcttataggcattgttttaaaatgttacatgtgttgtctaatgtaatactcatgacactatgaggtagtcccattttatagacaaggagactgaggcactgagaagtgaagtaaccagcctaaattcccataactcataaagggttgagctaagatttgaatccaatcaacctctgcatttaatgcctatttgtgagtgagtgtgtgtggcagaaaggatccagagtagatgactggtgaaattagatgtttaggcaatgtcttcacatttaagatcattgtcaaggagaaaattttgaaatgtattttgtcatcagaaataatccagggacacgtagagccaaggcctgagccagagaagaggtatttatactttgattcaaggaacatgaaattaaccaggaaaaactgaaaagcaatttaatccttagactttataggagtaaccttgttgggtttggtggatgtgatggaaagaatgaagggcaggtattgagcacagctaggtatgattctctttttgccatcttccattttagtgaccttgagcaagctggttcagcttggggtaggggattttgtatccacagtagcagagtgaagaattatatggaatcacttttttgcacccttcagattctaaaacacaaacgtttttgcattgtctaccctgatactgaaaattattgatacccttgatttaacatttatattctatcttattttgtattttgcacattgatcattcatttattcagcccctgtttgtttggggtatgctttgagctcactgtgtgacttttttccttaattaaaattagtctgggagagaatgtatttgcctcctggaattctcagaattctagcaaggtgccctaaacatcataagcacacatcagcactgttcatattgattatcatggtacagtagtgtatcaaatgccacctgaagttgagtgctgcaaatatgagaaaacctccgtaaaatcagccctcaataacttttctagggaatgtgccttaaaaaaaaaggtactggactgtgtgctgagaaaactgtaaatatgagtaaaatgatccctgccttcaggaagtttaccaacaagggcacaagcaaccattgtagaattgcttgtggccttattgatatacaggctaaggattaaaaaattataatcccagggatgaaaagctttagcagttatttagtccaactctccacacacattgagtccccgttacaacagcccaccaaatggttgtctggcatcttcttgaacacttcagtggctgtgaactcaaactgctcattctgctcgtggtagaatgacaggctctcaatttttgtgtagaaggaagtgtcttgctgaagagcaaaggtcttttctaggctgaggaaaagccaaggaggtcatcttggagataaaaatctggaaagtggaagtatatgggaacagacctcaaaggtcctttgttggagcaaagttacagaagtacaaaagccaaggcacgtggtaggaacattaagtagtctagcttggtcatttggcagtgacaggttgagaatagggaacagtgaaattgttaaagatagactgggactataatttggaggaccttgagtgccctctacttctggggtacataacggccctattgaaaaccctaattctatatccaataggtggctcattgagtaaatcactgttagcagtcagatctgatgtgttccccaaatccacatcctttatactcacctggacaactaccattcccccaacccccccatcatccatgaattttcttcagttcaaagagacatggttaaagcaggaattatgaaaagggccctctgccggccttatttccatgtagatctattttatatgcataataaccctaaggggaagctgtgtcaatctgccttacctgacagacccctaaatcctcccaatgctgcctccactattggacatgtgccaagtggcttgcaacctcaaagagagaaagcatcctgattttttgtgtgtaggaaggtggggggcagtgataaacaggtcttggcctgttattgtcttcctgcatgataatgaacccatcactagcacaggaatttaatgcaatgatttttccaagaaccatccagccccattgtagccctgcctgaaaatgtaaatacaccctttctggggacagatttgcattttttggtgaaagaaatgcatatatatggcaaagatgcctctgtaattatagaaagtttatttctgtccccagatgtcagcaatcaaattccacataaatatattttgtgtaaatctgtcggcagctggtctccattcaggtttctggagatattagcctgtctttgagtttatgacaaagttaaaaattattcattaaactgacctgcagtatattcagtaactggaaaattgccttgcagttctatttggtttgtagatgtgatcacaagtaaatttttaacttaattaattggccgtttctgttgacaagaaatttatgtggtaataatttgctcgaaatagatgccgactgtaggaaatgagatatccatcataggcttgtgttccaccagctgcacagtggctattatgaaagtatttcagcctgcgtcgaccccagtgtttgtgcagtcaagattatatatacccacgatccatagcctgccagagaggcgctggtggaggtctatgataacaaagactttgtgatttatggcttgctgtgaaagcagagcttgatgagattaaacaatttcatagcacaagtgtttctcaagacctgatttgtagttgcaagctgatggtaaatcacatttatatatctgcaagcgtgctcagcagaggactgcaattacagtttaagacagctactttttatttaatttttatcctggttttgtctcttttatatccccttcgtctgcaaaccattcaccttcacaagtcctttcctggttagaaggccaaagattgaagtcaatgatgttcttcgtgtctttgtgccagcttcagagggaggtccggcagatttcagagccgtgcagactggttcaaactggctctgactggtgtgagctctttgttcaatttcatgtccaaacagaagtctgtttgctattttcccttggtgtgttgctgatacttaaacttcttggtatacagagggagaaagaggggtcttcatcatcctgggatatagggaactgtggagcacataatggaaaagggagatgaggactaaattcactttagaacctcaacttcaaggttgcagcatatcttagggtgtacagttagctcccctttaatgggaaatgtgaaattgtgtttccccacagatctgggaggaataaactctgcaatgagtttatttaaccagtttattgattatctactgtggccacatgtcttcactgagtactagtacagcagtatttgccctcaggcagtttgtaatctacatatggtgctaaaacataaaaataagattggaagcagcaagatcagtgatagccttacacgagtggtgcacctgttgttggaggtcagaaggaaagggagatagagttcttcccactggggaagcatgaaggagcatgaatgagacaagtgcttgagggacagatcggatttcaagtaaggggaagaggaagttctggaaatttcagtgatctgtactgaaggaggcctctaaaatactcaggtgtgagttcaagtccaggctgggtggccagtgattgaataattataataataacataataataacatcgattgaatgcttactatatacaacaaagagtgctatataggtattatctcattaatcctcataacaaccccagaaagggagtattattgtgatctccatttggggaacaggaaattgaggttcagagaggttaagtaatttgatcatgttcatccaggtgtttggttgagctggttcaaccaataccctggtgtatttcaccccacagcctgtgttctttgccactgtgtttcactgcttttctttttctttttaaatggagaggaggtctcactctattgcccaggctgatcttgaactccttggttcaagtgatctgccagcctcagcctcccaaacagttgggactacaggcatgcaccaccaccacacctttcttgttttactgctgttagacagagaatatgaatgtaattagggaggcaattccactgttctgcatcctggtcacatcttcaagagctcaggtcatttctttttccacgaaagtacctaaagtttgggatgttatttttggtctttgtgataggctgaataacaatcatccgaatatgtccatgtcctaattcttagaaactgggattaccttatatggcaaaagggactttgcaggtgtgattaaaaaatcataaattgtggaggttattctgcattatccaggtgggcctgaggtaagcacaacggttccgaagaggactcagggaagtcagagtcaggggagaaggagatgtgatgaagcaagcagagattggagcaatgtgcttttgaaaatggagccaggggtgcaagacagggaacacaggcagccactaggagctgggaaaggcaaggaaacgtgttctcccctcacctcaattttgcctctatagggcctttttcagacatctgacctccagaactctaagacaatgaacttgtgttgtttgaagctgctaagttcatgtgaacttgttacagcagcactgggaaactgattctgtcttgcaaattccaaccagcttgacagagagtttaaccctgattttgaaatcttgggttttttttgtattatttgtttaagatagggactgatatggtttgactgtgtcccacccaaatctcatcttgaattgtggctcccataatccccaggtgttgtggtagggacccagcgggaggtaattgaatcttgagggtggatttttcccatattgttctcatgatagtgaataactctcatgagatctgctggttttataaagggcagttcccctgcacatgctttcttgcctgccaccatgtaagacatgcctttgctcctccttcaccttccaccatgattgtgaggcctccccatccatgtggaaatgtgagtccatcaaacctctttttctttataaattacccagtctcaagtatgtctttgttagcagtatgagaatagataatacagggatgctttttgatttccatgtttccccattctcccctcttttgtagccataagggaagtgatcatgtctgtttcattcactcatgaatctctgatgcctagtatggtatatggtatgcagtaggcactcattaaatatttgttaaatgagtcaaggagattacttcatcctatttccaggatatagttggccaatctgtctggaattcagttttttccacaactcaaccagcaaatgtcatagcttgctctttatgaagtcacaaagggagtagtcaggcactctacttacagttgtctgcaaacttggatatctcagtggagggagggggcagtaaggccttaggaaagccgaggctggctgaagaatctctaataagtcaatgtgagtggctaattgtgctaaatattaaaaaaaaaaaaatagatgtaaccctttatcctgatagcaggaaggtaggagggtttaataaaaagcatattgtctctgagaccctcacatgttttcatgcccgcattggctttttgtcttttatgtgataggtaggtagggagtgttttctacctatgtattattccaggttttatgcccctgagggtcttttagctggagacttataggcatagtccactccactgagtacagatgttaaagttgccaatgaagctctttatgagggatggagacaggccagtatctttggcctggattctagagacctggtttgaaaatcctgggaaagctgagagcttcgtttctccctctagagtactagtgtattagcctcccaataaaagttaattgaatttaattttatgttttaagtgtgatgcattttaaagttctccccagtgctagagtccctcttgaaaaggcagtaaattcatattattaaactaccaaatgtaattcagctcaaataagcatattcggcaatctttattctggatatgtgggactgaccttgcgttgaggctaaatcatttcatcccagacaaagtctgtttggagttaattggggaagcagtgtgggtgtacagcaggtcactctgggctttttattctctttctggccctcattcaaagagtcgctgtagcatacattttctgatgccagttcttccattattttataaatatcaatatttgacacagtatggaaggtgaaaaagacaatgaagatcttcccgctggagattcttcattagatgccctactttaccatattttaaaatgggcagtttgtcaccgatgcattaaagggctgtaaggagtggagaaagcacattgggctggaaatcagatgacctggattctaacccctgcctgtccattaaccaacccggtgaccccgggcttttctagtcttggggccttcattgttccacatttttaaagtgagagggttgtgaaagaacagtggttttcaaactgcatttcaagaggtacgaatattttgtcactgtatcttagcagctctgctgagtgaccagagaggggatggggtgagcagcagttaaggatgagaccagctgatgggcttcaggctctcagactcccacccctttgtgcagagtagctcacttcaatagcaaaaatcaacccaccatggcctaggaaagcttcaaagattctgccaaacactttaggtgtctaagatatttggggcaatttctccctaaagtttgtcaaggcagatgttggatcaagcacaatgaattgagtcatccattcttttgggagtagaaataacttaaaggatttgtttattcagatttgctgatttgtccagagttttaatgtttttccaaatttgtttctccaaatcctagctttgccagcccataatgtcatagcagctctgcgcatcttgacatgggggatctatagtggtaaaagcaggctggcatcctcttctcaaatgtctagcactctctttactattattttatgtacctcaaactttattattatgtcctctattattaatggcagagacaatgatataattatttatgctggaactcatgcttttgaatttattggatagagatcttctgaaactagaagatataacatatactaaatgtcccctcttatccctaagggatttcttttatctgaaacctcctgtttcacttatctctacattttggtggtgaatctggttgtggcttcttctttatttgccatctgcctgccccactctcagcatacaggtggctgtggactatctttattcatgtaatcttagttttgtttctatctaaacatcccatttgtcaagggccagaccagatttcatccttataggaattcctgcccagccactctagattccacaaagatcctgttctgaattccttcagaacctaattgggaccaaaaatgctcctactgtataacacagtgtcttatactattcattattggtttatttttcttaatctaacttgactctaagcaatttgaggacagagatcctgcaattctttggtatcttctgtagtggtagatatttaacataataacaaaagtatttattataataaaataatatttatgccagcctgctcctgttaggaaaggcaatgcattcttagtgagtggaaataaggtgtgttttgtttggtccactttttaacattgtattcataaacactctctggcaacaccatcattaattcatttccaagaggaaaaaaagttcttgctaaaaataaaattctgttccataaactctgtaaaaagaccagcaaacaaacaagtctcctctggaggaaccacagccacaccaggcccttcagatctaataagaaccttaattccatttgaatatctttgttgtgctgcactacgtggtttgggattcattttgcattagagaaatgacaaagacccagaaaacaagcactgagtcaggactggtttcaaagagctcagcttcttcgtttaatttccagttcatttatttgagtactgtcaaaaaccaaaatttcaacatatttaggttaacaatataatggccttttattagtgattcatgaactaggcagcatcttaatctaaaaatagaagtgctttgttggaaatggaaaaaagtcagtttttgaaaaataacagatgctgatgaggttgtggaggaaagggaatgcttatacactgcttgtaaattagttcagccattgttgaaagcagttcggcaatttctgaaaaaacttaaaacagaattaccatttgacccaacaatcccattattgggtatatacctaaaggaatataaatcattctactataaaagacacatgcacgtgtgtgttcatctcagcacatttcataatagcaaagatatggaatggaacctaaatgcccatcaacagtagactggataaagaaaatgtggcacatacccactatggaatactatgcagccacaggcatgggcaaagatttcatggtgaagacgccaaaagcaattgaaacaaaagcaaaaattgacaaatgggatataattaaactaaagagcttcttcacagcaaaagaaactatcatcagagtgactccattttggtttggtctgttctgttggggcctagtgcaggagctcagtctaaaagcatggcttcccataaattttatttaacagtagaattcttcagtactactacaattctttttaaatgctatgaccagatttgcacctccaaccccaaacccctcaatgttagttactacaatataaggagaaactgtggtttccgtaggagaaaggaagagattcttggaaaattgcttgggatgtacaaagccagagccaatcagtcaatcagaaaacatgatggagggccagccccttgcaaatcaaatgaagccttgctctctgcccatgatgataaagattatgttacaagaacagtttcctccaataaagtagtagttatggaaacaaacaaacataaaagatatttaatatgttcattccacaagggtttattcaataatttaatgaatgaataatttattaatggtttgcccaaaccaagggcaaggacatattacagtggaaggtggaggtgggatgttggatttgcataagattagagaacattgatggtatctttctctaggaaggacaaacttggcctgtgtggtgctgaagcagatatttccagagccttcctcaatgagggggaaattcggagaaaagaaacaaaaagtggacttggactttactgaattgtttcccattcccaagtttttaatatgtacagacagaaaaatagacagtctctttttgacaccctaagttgtacctgccaaatcatcagagtggcagaattggcctctgagaatgtgaggtcgccttcttttatgactatttccaatgttatttttttcaacatctcctccttagtgtttgtaatgcagagaacacttaaagtgctccacagacatggagcatttccattaccctatgcagtattacaggaagtagtttataaggagttcaatattaggaagagttatctaataaaacgcattgtctaatctccctattacaggcgatatttggatagatcctggttaactatagtctggcattttcaggaatacatttatgtgtacggtgaggcattgggcttggtgtcttccaattccatacatgtagcaaaaacctggtggctgtttctcaaatgtgcctcataactgaccaggcaaaatggatcagtaattgtcctgatgaattgccctttaattaccctctttcaaaccaatccttttcgagcatctgatggtgccaggttattgacttcatgtctttaggtttggacactttttgggcaggattattccgaagaaccacgatcatctagaggaaaacagaggaagtttcactgttgattctgagagaagaattttgagggggagcatttacatcaggttctccaatgcctgcaaggcttctgcatttctagtcccaacaaattcttcaaaatttttaggacaagattaaattgtaaccactattaactgtgtgcctaggtccatattcatgcatacctatccctgcctactttggcagaatgagttaccagtgtatgtagcagaataaaacagacttttagggtatcctaaatactcccaaactttattgttacaatctctttaatgggccttatccttcaggtgagtcagctggtttaaagagttatgtaaggtacattagcccttaaacatatttcccaaaatgctcaattctgaaaggaatttatttccttgttaagactgagttgaaaagcatgggtctgcagcaagactgaattatttatattagtgatttcttatgacaatcttataagtaactgtacaatttaggtttattttctctttttttttttttttttttttttttgagacagagtctcactctgttgcccaggctggctggcgtgcagtggtgcgatttcagctcattgtaacctctgcctcctgggttcaggggattcttgtgcctcagcctccccagtagctgggattacaggcgtatgccaccacagctggctaattttatatttttagtagagacaggatttcaccatgttggccaggctggtctcgaactcttaaccttaggtgatccaccagcctcagccttccaaagtgctgggattacaggcctgagccactgccctcagactctgtcctctattccaatggtggtggttaggtggacatttctagagaaacctgtcttacttcttataaggaggtgctataccttcaaggtggagacataccttgcttatttagtatataatgaagagatgagagaccagttgactctgagaagtagtatgggtatgtgtgatgtgaaaaagagtcatgaactactttgctagtttcagatgtaaattaatgttgacctctaattaaaatctttcaatttatatataatagctcaaagaagagcgagtaccatgacactttagatgatggtttcaaaatgacgggttttgggagcacttttctttggtacttcagcctgatcctccaaaaaggaaacaaggatttatttttgctcaaggagcggtcaatgagtgttactgcaaaatgaatctgaagtttttctctgtcttaggagggatgcaacattcacaatttctacttgtctgtctgctgtcttcaccctccctcctccctgtctttcactgttgggtctcaaaataaataacacagacacttcatctttaacttcagataatcagagtcacaatcatctgggatattgtgatgaacaatgtacatttcatacacatgatgtcataataatttaaaatgtcatctcaatctatttatgatcttctaatgactgaaatgttttacaattgtgggggatattttataactgaagttttaatggctgaatcactaacacctggctgtctggaatgcttttctttctcctagttaggcatttaaatgcatttctggaaggcccaaggggtgggatgtgacatataagctcttaaaaggaggaaaattagttcttgataccttaatgatcagtcaggtgaacgtttgcatacttagcattaatgctcttaagtggaatagcttgattaagacccttggtaggattttttttttctttaaacatccttctatgtgagattacagagggaaatgctgctattatgcccatcccttaaaaaagatcttagatttttcttaagtgttttattttctaactctattgttttcactactttttagttttctatctttggtttctaagacaatcaagttacctctttattgagaatttagtgtatattttcattttgctgggctaatatgtatatacagattatatatacacccacacgtgcacacacacacacacacgtgcacacacacacacacacacacaaattcttgtccctggatgagcatacagttgcttaaagaagaccagacatatacacatgaaaatgtcagtgaaccatacaagtcaatgtataattaagcccatagcaggcccccggtggatgtttactaatgatgatagtggcactaaattatctggtgcaggccaagagaggtcagtacaaggttgcccagaggcctgcattaaacaatcactgagataaagatgcattttagttcctcctatctgtacaacatatattaatatatagccttccaatgcaacatcccacttaatttccatagtaatccactgaaggaattcgaggtgtatatccacagtttggcagaagggaaaataaaggcttagagccatcagatcacttgcacaaccaagctcacagagctgggtggtgacggagcagagcctggactccacatccttgggaccctagtctgcttttttaccccaccatgttgcttccagttcacagggtttctagcagagtctctttaggctaaattgttgccttgaatgggcaatttgcttgaaatgtagctggatgtgcagcatctttgctcatgttgtagccaggaatataatggcaaatctctgtatatttgtttccaatgaagattgactacactgatgaaataatgataggctttacttccatttttatcaactaatggtgtttctggtgacaagtccccatgatactactttatgactctttatgcacacgcttgtgtcgctcctgcattctagatagattgggctgatgttacacaggcctgctttgactgacaccagaaagccgtgtgacaattggcttgtagattggacagttaatatagagaagtgtcatactatcccaattgggcattaagatgccatagacatggctaaacagggtggctccatctgtgaacaaaaggccactctgaaatgtcagaaaccaaataactaggactgctgtgcttgcaaatttgcaaaatggggaaacagtgtgtgtatttaattatttatttatttatgatggattcttgctctgtcacccagtctgtaatgcagcagcacaatctcggctcggctcactgcaagctccacctcccgcctcccaggttcatgcaattctcttgcctcagcttcccaagtagctgggactacaggcatgtgccaccacacctggctaatttttgtgtttttagtaaagtcattgttttgccatgttggccaagctgtttttaaactcctggcctcaagtgatctgcccacctcggcctcccaaagtgctggaattacaggtctgacccaccatgcccagcctagtctgtgtgccttaatcattgtatatctttaggcaaatatgttatctctttagccccatgtctgtaaaacgagagggtaatgtttgccttatgatgctcatgtgttgattagactacccaaaatggtaattttgttgaaacatttagaaaaatgtgaagaagagtgatacaaatgatgtctcatgtttgcattgatgtcatttcagatttttgcttctaagtatcttcctagtggcatcatacaggtgatttggcctaggttggtagccatagtttagcttttacaaaagactaagagttcccataaacatgtggtttggttctttaagttcaagccttagggagataactatgaggagttaggggtctttgtaattagtcaaattaatgagccaaaggccacatgtggcagagttatctatgatttctgtaaacattataaaattctcatgttaccttatctcttatatataggattccagctgggctatgaaaaatggctcaaaccaccatctattcctcccatttatctctgagaaataactcaagacccttaaatctgtttactctctggtttgttgtaacattgtaatatttagcttcatgtcactcagtcataattaaacagttcacattcatattctccattattggatttagtagccattctttagccacagtgtgcacttggaggttgttttggtgcttgtttttaataatgctttcttgaacttctacagtaaatacactttcccactccactggataggagaggagttgacaagctgggtgttctgatattggctgtgctgatgtttgctcataaattcatccagcaatctcttgcggaaaatacgttctaaacttggtattaagtttttgggcctatgaccagagtgaactcattttgtgtgtgtgtgtttgtgttaatccttccaagagcaataggttcacttggatagttcttagtttctctttttaaatttcttgattaagctgagagagttcacactggaaactctttgctttgctgattgctccagacctaatacaagtagatcttcaggggaaaagcaacatggctcatctaagtatttacctttatactggtgaagtcatctcttggtgtctatcttcatatttcccaaagaacgtataaaacacatcttatttcctttcctaagtctgaggccttatccatatattttaacttcagacttgaatttgtccttgtccctgacctagtaaacatttttatcaagaacatgtaaggagctggaaaaaggccttttttattaactttcaaagtataaagttggagaggtcagaacattccacaggttttagatcatggttccaagtggtcccagcaagctaaaacactgcctgacacctatcagacaaaatttaataggattgtaagttagaagtcctagctttatattttcaaaaatctattattgaagtatgtgcttgaaaggtctggcttggcagtgtttcaaatcaaaggcattgggatattttatttgactgaggtttgatatataccagcgtagactatagcttgggaaggtattgccaacttggatgtgatggaggctttgggtcacattgtcttcttgggattcatacagttcacccatcatctagaggactaggttcaggtcagaggttcatgttttaggaaaaccagaaaaactaatggggatcttcaggagaggcactaggctgttgagtgttacggaaatatttggcatagaatagaggagattaagatggtacatagaacattatctcaaatagttgaaacattattgtggggatgaggatgtagcatttgtaaaggagaaacctaggactatggtttaatggtataaggagggaagttttggcacaatgtaagaagaaagttttattaaaggatcttattaaacaaaatgatattcttccttacaaagatgtgggtgctgattgttctggaagagctaagagcagagctggaagaccatttttgtaaggcattgtagaagagatgtctacgtctgtgtgggaagctggacaggtcaaccttgcaggatgcaaggactcatttgaattcaaattcattgttatactgagaatttcaaagtttgcctatacattttcagtcatttccttgtttgtattcaggttattatatagcattctcagttagaaatatcacatggtcactaaacctggataccaggcacagtttgagtttctaaaagttgaatgagctttcatggacactgctgccgccacctctttgggtgtgccctctgctttgcttttgtggtagtgtcacggacatgcactggctgattctagctctcctctctggtaacccttataaccaataagtgctaaaaggactatagtatccctattgcctttcactgccctctaactcttgcttaagctatctctgccccacctcctctagccctcttcagttccactttcagattctcccttgacccttcattttctccttgcaatggaaatcctaccattttttccaaggctcagctcaattccatttccttcctaaagtcacctctttgctaatcttcactcatgctaatcttcactcatccctttctttgggactgatacatctttggaattatctagcatagtgcttaattgttttcacattttcctgtctcttaattttatctcccaatctccatagtacgtaatttgggattagggactttgccttactgagtactgcatgaatacattttattgatttactgatttgattacaaatatgatcaccacacagaaccaactggctgaaaagaattgtgccctgactttggcttcatcagcacaaggtcaaaactaaccaatttatttaagtatctaaaggatagggcatcatgtgaattatattaactatcaaataagcctagtttgcttattatttagacattcttctaaaccctaataaccccttgtcatctctgttatgaggccaaggttgcacgtttagaataggtttctggaaggctaagctgcagagccataggcagatgtgctgccactcctgcaggcttattcacgaggtggagaaaaattctcttccaagtccctggcttcccattgcaaagtaaaatgatctctggtttagagctactcaaagggttaactttgactccttcaccaaacccaactatttaatgtttttaacggcataatgtgttaatagccatacagctgttgtttctcagcctcttcctttattgagttagacaccatttagtaggctgagttcaaattgtaaacaaattatttttgcatatggatcaatggaaatttaataaagtttattaaaacagtatattggaccaaggagtgctgttttctctcatggatataaaccaacctcattagaccaacccatagtaacagaattgcagggaagaaagtatttctggtcatttaaagattattttggttcaacagatggtgactagcatcagagtatagtttttcttgtttgttaattcatttgcatgaacatatttgatggatacctagtgatcccaacatgcttgattttagtgcctagtgtgctttctagcacatagcaggaagttgatagagttgtcacagaggggattgtgatctcaagtgcaaagaagtggcgtgagatgctgagagtcacacagctgttgatgggcagagccatggaagagcctggagctctgagctctcagtccagtgctcctatcactcacacaatggccctcccttgattcactgcctgtgaaatgtcttaaatgatccgcagataccttctgcctgttctcatggcaatcccagtttatgttgcaataaatgttatcttaatctcaattgattgatgagttcttaaaataacagcattaccaaagttcccactcacattgtaaatcgcaaatattccactctttggaaagcattcagggtggctaaccactatttcagatatggcttgggcagccccactcttgtaagaggtatctgaaggggcttttaccagaaggagctaaatggttatcagataacttagagtgggatacagggaatttgtagtaaaggcctagattccgcaacacaaatactgactgccctgtggatttgaagttaaagcagaagagaactaagatgggcctacttttttggccctgagtgacagcagttggcagaagcaaccctttggggtagtagaacaagcttggagttgttcattccagcttccttgtgtcagagtcactgttaagtaggaggtcgttctgttcgactctggttggaatcattctgtgtctgggggcctgtcgtttctgtcattcttcctggaaagtagaatcctaaatatgggcagctggtttggactgaaaccttggtgacttctgaaagttataacaaatggaagtcattatcaccattgcccccctttacctttgtgctacttgaggcagaaaatgatttccccctcccccggtttgttttggagtctttcatccagagagaaaaggattagcctatggctacaatagagctttcagggccttttggcgtgctgcaaatgtttacttatccaggtacaaataggtaaaagcacatagttaaagcttccagctgcaaggtcatttacctttttaaaatgcagccgcatgtgccgactgaagtcgagggcttgctggtatgagccattaactgcctgttgtacgtaacctctccttgtcttacacacagctgcgtgcgagctgctggtgccatgcagccagcccaccatgcatgccttgcgagcaacaaaagcagtttaacttgtgatcactgatcatatgatccacttacagggtgcaggctcagtcaagtagaactggtaaatcattaaaaatgcgccttgatgctatgcctgctgagtaaaacatcatgctaacatctctgcctcccacccccaaccagttagcagcatagggaaggagctggtaccagctgcatattggagaaatccagttggctgagctggacgtggtgagagattgtcagctgcttccaagcagcattggagaggaaggcaggaagacagaaataatctggagtggctgccatcctctctccttgtcctttacttactcattaactgagcctgtgcaaagggccttctgtgtcaggcctggtactagtgcctaaattacaaaggtaggagaggaaatgaactctgacttagagactctcaaagtctgtcaagaactcagtcaccaccaagtactttcacataggcacccatgacgtgccgtgcaaccctaagaggcctggggtagccaaagagatgatgcttaagctgaaccttgaagagtgaatagaatttcatcaaggaagcatgtagttaaaggaacaacatgggctgtgccttaaaaagttactttctagaattctttcttccatgaagcataccattctactcagtttcttataggttttaacaaattgttttgtgactgtatgatggaaggtccaatggatcctctcttctctccatcatgtgggtctaattgtttctggcatcatgttactcagctatataaacccttctgggatgggactgtatctcttcagtattcttgattttccttacagctccaaaaacttggggagtgggtattgttggttggccaccttcttccattttcttgattagaaatattttctttgacttattttccttagaaaataagaaattattaaattagaaattagttgctttcacttttaactaaggcaatgagacagaacataccagatagatgttcctcctgcatatacgtcaggaacatctgctgttagagaagagccgtgtgtgtgtgtgtgtgtgtgtgtgtgtgtgtgcatgcacgcacgcgcaatatgttttaagtatattgtgtgtgtccatatgttctgggatattgaggtttctcaggagtcctgcagtttgcatggctgatacaacctttaaaaatgacttggacttccagaggctctggagagtaggtttaataaaatgttcattcctttagatgtgagactatgccattttactttatctagatacaccactgtcttccagttaatcatagcccttaaataccttcttttgcttctcaaaaggttttacctggacccagaagttcatacagaagctaaactttgggaagaggtcagatgtggaatccgtgctcccttccctttttatacttgctctgctctgcttgtacaatgaatggtcagttagaatgcctttgaaccaccccccttcctttctttttttttttttttatgggactcattcctgcaaggacagttgtttcctgcagaataactttctcattcctctcaggactactgcctgggggccaaaacttgctaattagagggttggaggaatcttcgcaatctgctgtcttcattttcaacaccagtaagagctaacctttggctggttgtaggaatgaatgagttttgtcctctagaaagatgtccgtcttcattgtacaaagaaatggaggcctgagactcaagctttgtaggattaagattcagataaaatcggacaatttgctcagctttctgctttacatctttgtaaaggaaataatacttcctcatacctcccctaacttcaacccaatctctaaagaaatgagagaaactctaaatctgttctaaaactaggggtagtcatggcataataggtatgaaagatctgttcttatctcttccttgtataggggcagatatatagtggcagaattgagaataaaccaaacaattgagtgttttcagtagaaactgatatatgactaaccatgtacctatgaacatatttgattggtggtatttaaagagttgtaaatatttctcattaaaaatagactgtgagatctgtagtcatcaaaggtgggattgccacttgtggaggtagaactttgttttatttgaaatcaagaaaagttgtgcagctacatttggggacactctgggttgttggcacaaaatttaaactcaggctatcaggaaattcctcagtgggaaggcatttcacaaagtcgagatattatccattgatcatggtaggaaagcaggcaagaaagctgtgttctatcctgggcaagccatcaatgcctggggaaggccctttatttccgtctctgtgttctcatctgtctaatagagaagttaatacctttccaacatacttcacatgtgaaaatcagacagtgtaacaggttctctgtctttctctcctggaacagatgaaatctcttccatcattcagacgctaggctgttttgtttggactctcttctatgggcatttgccccaatccctttttctatggtagttattgacttatctcatttcctcctacaacagtgtaagttaccttaatttgcaacagtttactcctctcaacatggtgcaaagagcacagcacttgcatcaggaagccctaggaatatagaatcagaatggaattctgtgatggaatccaggcacttggtttccccaagaataccattgtaggattgttctatctgccccaccatcttgtttttgggagttaaacaggagggcttatgggaacatgccaagtacatagtacatgcttagtaaccattaggctccttcccttagttctttgctcatagtggcaacttaatatatgcttttggaccaatcaaattttgacaatgaggaggaaatccatgctatttgttttttttccttctggttaagatgttcaggagagaaatagccctgccctcagttatattaaaaatttaaaaaattaccatttcaattgttgatacaaagtatttttgaggtctgcagaagacacaatgcaaattttattaagttaccattatccttgtcagtgaaattagagcatgtttctaatcagtatcttcagcaattacagacaacaaggaaataactcatgctgttatatgaaacagcttataaatttttacatacatgtgagaggaatcacttggaatccaaagctgccaagaggaataattaggaaccacagaacagatcttggtaatgtgacagcagcttctaaaacatcccacaggacgaagaagcgcaagctggcttgacctatatctttaataatacagatcattgcccttggattgaggctaaagggtaggaccaagtgcttgcttcatcacgttttaggaaaaattgccaaagtatatttatgaattcaccacacaatggcctcttgctttgattatgaactgacggatctctctaagtagcaactcagcatgcaaaatttaaaacaaaaaaacccaccacagagcataatttcttatattctgtcatgcttggcaaaaagtattatgtaagacccaagtagacaaatggctgttaacagtagaaataaccttttgtttaattagaaaataggagctatatgggataataaaaatggttactgatgccctctgtcactgtttaataaatacgatcgcgctagagataatgggaagtgttatttatttgtgcaatatcacagacttggtaattgttcatgttgttgagcattttcctgtgtggagatcacagtagttttagaatttgtttcctttgatctaagaaaaggaaatagcaagttgtttgcttaaaatgttcatggcctccctaggctggagtaaagtatctgcatatttttagcccctcagttttgaggacagaatctctgtggcgttgtctgatgcatattgagaactggtgcgttattttgaactggctctattttttttttccagagcgccctcaggtgctcatggaacatacttctcagcaatgccatttcatgttcagttcagattttccagcacaactaaatttagtagccttgctggagggaggaagtggagcagagctacctacctgaggatgtgttcatgggaagagaaaaatctccctgttgctccatcttgagaaccagcatatgggatgaagatcagactgaatttccacagcatgtgtttcactatcttccctggggggtggtaaggagaaaaggctgaaggtgttggccatgtttcagggtcacttccattttgtgtttactgtgaacactttagttgtgagactgtgccatgtatttggggtcatctggctagatttatttcattgcacatggcagttcacgcttggtttcttttttttggggggtggtggtggggattctgttttcttttgtattgtgattgctggagtggatactcttgtttcttgccttttagagaaaatgtttgtggtttgtgatattggatgatttatttcttattatggcaacctaaggatttttcactgttgactttggtgattgtgagatatttcctcagaccctgaactaacacttgattcttctcatacagagaaatccacaaaaatgagatatggcacaaatttgtatagaagtgttttgtgtgaccacttatttctgcaagtcctaagtagccctttctagaaggtttccatgtaatacctttataaaaatatagacagtttgttaaaaggaaaacacaacgcaacaaaaccccttttcttcacacaattcattttaagcttcaaaatccctgaaaatccccaatctccttttgcagtctggttcccactctaactttcctcatctccccctgaaagaaagaaaaaagcatttcttccagggactgataagttgtaggccgatgcttagcaacagcattcctgtgctttaagtagctgcaagccccttgctgaactctttgatgtgactgtcagggcagatttattttgttttagcacattgtctacttgtccagatgtatcaggagataaaaaggagtcatgtttacactcctcccttttttttttttttttttggagatgtaattaaatcgtgtttttgatgagtcttggggagctccagttgaagaaaacaggaattggctggagtaaagggaagaatgaaaacttgcttggcagaatgaacacctgactgcgtcaaaaaataaagcataagtaccagctggcgtggttctgtgaagctggaggttttgttctgagtcttttgttccacttctgtggaagtccaaccaagaagaagggagaggtgcccgtccagcgctcacttgctgggcactatctgtgaaacctctagctctcagtgatctcttctttcttactgcacacaggcgcgcacatgaggccttaactcccttcttccactatcatttagtgggtagtacatctgtgatagatagttgtcaatctaagctaataaaattgttgaactccagtgatcttgaataaacaaatcttcaccgagctggatgagttgaattccctgggaatgggattgccactctttttttttttttttggtgatcagttttttaatgtgcacatttagtaacaccattctgagttctattaatgacctgcagtgagcagtgacaagcaggaatatgacattcagtactgctgaggacctgccaggcagcggctaacacgctcgctttcatctgcagctcgggagacactctatttgcatcctaaataggttacactacagcacccccttctgccgactgagctgtgtgacaagaaggcctcactacaactcagttttctcccctgatgacagccctgaaggccctttcacggctttctctaacctttctagccttcccctttggtccctggaggagcacaacagtgactaatggtgtgcgtacctgcactcctgggggcttcatttggattatacttttaattactcattcatcagaggaaaggaacaaaaaccatccattgaaggagacagaaagatgggtataacaaaaagaaagctgagccaagcaggtgctaccttagatcactcctggctggggtccctcctgccagatcccaaatcccagacagacgccactgaatgcatcttagaaactacaggcttggttttgtgtttcccatttgtagcccagtctgaagtacaggaaggaggttttcctttgtttgttctaaacaccttttggatgactccatttggcagaagcgcaccttaaacttgtagtcctttcacatacgagaaatcaactgggctctgctagaaaggggtgtccacatggggaattttggagggaggaactatgcatgccacctgtccaacactgagaagccctgtttgcaggggttggggtatggggtagagagctcccatcagaggacagtgcagaggctgacttagcctgggaagatgtggacttattgttatcctccacccttggaggccagggaatgctatttgttcaatattttaagttcatttaatttaccatttagtatttatcgagaagatactatgggccacccaggtggagtagggcgctgccctcaaggagcaaagtgtctagtagggggacaactcaggcaaagcatgttgggagggagttaggaaggaagactaggctttgcaaagatctccagcaggatggggcacagtgccctgcgggagcaggagaacaccacgtgatgactctcagggtgaggagtgaaggcaaaagagaggctgagaaggcaggggctggggcagagggccttctaggaaatggatggtgctctttgcttaccccaagagcaaggtgaatcactacgtttttaagcagagaggccccagtttccttgtgaatcttcgtggagtcctttgagctctgtaaccatctgggttacaggtcttctttgtgtgtctcactaccatgccttacccttctgtaatctgtctgtgcaagtgcacttgcaggataaacccaggagctggagaaagcagaggagtttctgtggccgtgtttacctttcaaaacctaggaatcctggatatggaataagagaaaagagggcttgtagcatgtgtgggccctttcttgggccctttctatcttataattggtacaaaagacagtagatggtagaacggagtcaggaaaaatgttggaaaatgttttaatggatgaaaactcatttggaaagtaacctcaaaacatcttttttctttttcttttctccctcccttcctctttctttctttcatggtcaggacattggactgtcctgagcaaaacatatacctagaatgggatctcccacccagggtaggttcatgcatactttgtcagtgactgagtccctctagaccacaatgtgtttgagagttgaagactaagatgggcacagggtagtgtttctttagaaaataaacttaaattttgcatttcctttggcttcagggagaataaggctgctagaatggttagaaatattgcacaggacatcagacttactgattatgatacttgattagtcatttttcttgtagtaatcatatatttgggtctggaatctctcaaggaaatagcttcacacatatgtatacgtttagatgaatgaaacttttgatgttaacagttattgatagtataaagcaaataaaaaaggcctctttcaagaacggctctgtgaataatttacagaaaattttgaaaaaagaaaataaaggagaaaagatttttgggggttatttctcaaatgactttccatctattaaactattttccaccatttcccttggctccaatctactatattaactatattttataataaacacattagtattgtgaaaattaatatttaataatgtagagtccttatctagaaaagttaagttcttatctagaaaggtacacaggctgaggattagtattaactttacaaagaaagattgggtttggaactcagagtttttttatatccttatcctctcctctgcaatcaacacatacacacatacttttgcatactgcagcccttttggaattccaaatgttagcatccaagcttcatggttcttcttcagattttagctatcctgatatagacactgagagcatgtgggctctagcccagaagagttttagcagcctagcagagcatttgtacatatccccctttggttgctatagtgggtgctgttgaattgctaagcagagaatcctgcctactttctttgggtctcttgggggaaatgaaactcaagtgtagcagctagtcctaagtctgtaggtcttcagttccacatcctaagtcacacatgacacggggcatggatcttcaggggcttacctaagctgtccaggacacattgtcctcatcctcaacacaatgaacctggaggcttggatatattcaaggcaaacatccttggcatctcttttagaaataggcctgaaagataaagagggccgagtgatagagtaatggggaaatgcttttggaaaatgagagatgcacattagaattaattttcccatacctttgaggtttgcatatgtcaaaattaaaactttttagactgttgttcccagaggacttcctcgtgctactcttttgtactggtcacatattctcttgtggtattatctgtttaatgtgtggacaaaatgtgtatgatgtctcattcccagaattgataccagtagttgcttgacacatgctaattagtaattaaatatactgtattactcctcacttaaacagaacataccacactgagtttaactttatcctgttgacatatatatgtgtggaggagtggaggaagcctggggtgtcatcatttcagaggtctgttgcagcatcttgtggttcagctcttagtctagctttttgtggttgtttctttttccatgtcatactgtgaccccagcagctacccttgcccacccctcatgttgctctatttagatgcctgtggctgtttttaatcttctgtgggataccaaagcttagaagaataaaattgtatgataaacctgcctgatgtcaactaagatcctgaaaggtataaactttatgatatctgcaagacctcgtggggagggttttctggaggtggaggccttttgttgatgttgatgtcaggattgagccactgcataatgagttcagtttggcctaaagataatgatgagatgttttgaatgtctgggatgcagtgaggggctcctgaagacttacacaggaggtcgtctgctttcgaaggggaatttgcccttttggcctctttggtgtccactacactgtattctgggatagacctaactctgtggaaccaccatgtgaccacccttaatcaatagtggtctgatggggccagctgctctctcagcactaggagtggcacaggagccaggctcaatcaggtagagggttctttctcatgggtgaggagattctttccaggataggcacataacccaaagcaggccacggattcccagattttgttggaacttacaggaaagagaaactctttcttttgtctttgaagatggtgaggtacagatgtggggggctcctgggaggccaccacgtggagaaaccaagaaacaaagctgagatagaaatttctgatgagaagtttgaacacctggatctaaccgtatatgaaaccatataccttgagctcattaaagccccctgctcctctttttaaacttaaagcactttgaggtggatttcatgacttaccatcaaaaggataatcttattttcctgaactgttcaacaagggagattctacaacttaccctggaaatgtagcaagtggtccccatagagtcattttggtcaagaattcttaattgtgtgtgacttaaatttcattttctgacagtctctctgtaatgtaaataacaaaccaaccctacttgccctctccccaaatcaaaaaatcctcaaacccaggaacaaaattttgattagtctactccttccaaagacaccttcatctacttgaacatcaattttcaatggtcccttcaaccttctctttaaatactgtctttattatgcaactttgaaatgatctacctgtagatatgtatggcaagtgtcaacactagtgagccatgagaatttgtcatagcagcgatctcacaagcatatcttgaaggttttcctgtggtttcatcctggcatctggtcctgaaagacgaagatggatagggagccacatggtggctgttcactggccccaggaaaggccgtgcttgtttcccctcccaagactacttccatggaccgagacaggtaactgcagttacccagtgactggaggagatggagaagattccagtagaaccagccaatctaaacccaggtccttctctgtgaagtcacctttgctacacatcagagaccatggggctgctgctttctcaccaatctctctcctgctctcacctctctcctcccagcctggggatggagaagccatagcaagcacccatatggctcacattttcttctcctcaaaacctctccccatagttctgtctgaatctgaaagtgacggctccaattaagacacaggaagaaaagaaatataatttctaagtcacttggcctggtgacatatatgttgggagttaggaaagtcagtgtgcggcttctctaccatcccaggcgctgcagtcaaacaaatcaattcagccttcagaggggcatccattgccttgtgattatgtttgtgtaaagtcttggggtctttgatcaaagaatggcatttcaggccagtccctaatcctcactgccttaagatgtttaaatgggttaaaaaaaaaaaagttgataacagctgggatttaaatttgcctttgcccagcttttgttttgaaaggacttctattatccgtggcttcccttttcgaggcaaagatggatcattgggtaaaccaaaaagggaaagaggatatgggaggaaatgggcggggactctgaattaatcttctgaggaagaatgtttgatcagcggggaggaggggatgaaaacctctgatgctgacagcaggcacctttctgatgagggtgtgattggcacctttgaagcttcagtcaggagccagtgtccagtgggtcagagcttcctctgtctgtgggtggtggaggtaataatgaggcaactggaaggattaattgcggacaagcagcaggattacgaggagggcttctcagctccaaaaggaacagttcgaggaaagcctctgatctgtcagccttagaggaaattagtgggagcagactcgagcaggcttaaaaaaaggcatttaggatattaaagcgaaatgtgaagaggatattaaaatagggcaaaagggcaaggagcgctgatcttgaaaggcgggtgtctccctcttattactaggaatttccaagttttgcccagatttcacagacaccttatttttacagtccagcagagagattttacttgcattgcaacaagttaggggagggtcagactggatttgaggtggcacccaaggtcctgtacaaaacttgtttgctgtccaccctctggcagtttcagaagctcctgaaactaaggctcctggtataattttacaacaagccagcgcattactgacatcctatctgcattagctatctgttgtatgttttacttcttacccttctggttcaagtctggatgctgccaataaatcctgtgttaccattaaagaggccattcatcacgcttcctaatgcgattaatcaagatacaccacagtacccttaaaatgagatcattttgataaatcatgtatgacatgaaaagactttattccttttaagtgcaatttagactgtaatttttttcctcatttatgattcatgggagaaacatggataaaattcccttgcacagttacaccttatctacagcaataactcaaaactgcttttagatgaaaattcagggtcttattcaccaaagctgaatgccagctcattattttctggcgttcagtagtccaaaaataatgtccgcacattaagcggcattctcaaaaaagttggaattggccaggctccaggcacatcaattacactccatcatccttaataaggaagaaatatcagatgtcctcttggaggttttttgaatcagtaatgctcagcctttaccttcccaatttagaatgattgggaaacaaaaatggtagtaacaaaaaaagtatgggaatttcagggcctttacatgactcttctcctgttgcataagtctcaaaagaggtattttttccctcccatgcggttcatgcttccttttccattccccttttctcatttcacaaaggaaactaccattttgttaggtctgagttttgtttctaagctgctgtatctgtgatgcaggctttcccctcacagctgtcacaataatttgggaaacgatattcataacctccaatagaaaaataatttgaaaatgtgccttctggtgagatccatcaagtttaaggccatatttttggttaaaagggagacactgatgctattcattaaactgaaaaatggcttgttttccactaatattgaaataaactctggatgaatgttaagtcatgctggcatgcactcttattgaaagcaaaaggaaaacacagatatatttaatttggacatgtaaagtcaacagagttttaggtctttcatgagaaagggaatcaggaagattggctgaaacaaatgtgaacaattagaagttcatttgcctcttgcaaagagtgagagcatttaaagagggattcagtgtctgagaactatagactcacttgcatttttttttcaacccctggtacctatgaataaagaaataaagacttgatcaacatgtaatttatttccctgctgttcttagagattcatttgggaagcagaacaaaagccagtatttgactctgtttttaagtaacccaagaatgcacacgtatcctattcatgcccacttaacataaatgcagcaaaactcaagtttatttgggttatcacatttatgctaatgctctgtactttaatcggatagaaactgacataaaacaaaagttccttgcatattattcacacatttaaatgaaatttcctgtgcttttaattttttctaatatgaagagtcaattaagaatctaaggccattaaggctgcacttgccttgtttaggtttccatttcacatttatgactttctatttttgtgaaaaaagatctgtaaatttgaaaaatatgcacgtatctcattaaaaaagtttcccagctctagcaacactcagcaaatctccaaagaatgcaagtttaaaacataaatattttaaggccccataaaattggcagtaaatatttttccccctttaataccatgttcatttcattccaatttactaccacgattatattttccaaagcggcttttaatacaatacacaattatttcatatggggttgggtaggtcgcctcattaagcctgcaaagatcaggcctcttgtgatccccacaaatatacttgcatttactcctaattaaaatggccctcttaaattgtctcaagttcattaatataaataagaagctaagcaaaatagccacagttgaacagttagcagggcaagatgaccaggtccccaaacctcacacagagcagactgtggtatgtatgcagtggtgccctgccacctgttggctctgcttacacataacagggtattgatgtccctcatggtggtgcagtaaccctctctgacccctatccctagttcatcatccccaagagaaaagaagaggcctttgagaatcccaggcctcctgatttcccccatcattcatttccttggctacatgtttctcctgctaatgctaaaaatttatggctgagcacattaagggcagtgcgagtccttccctacttctggattatatcagagtttcctgtcataaggaaatccaagatgtgtcctcagctgattgcatgtgacagtgtctgcttatatctcaggaatctgaggcatgatggataaactgtcagttttgaaggatgatattttctccatatttccattatgaactgggctgtcatctcctaataaatttcttgcattggtatcaatttatttttacaagcagagggtctgatgtatttgggaaaggcactgacagcagatctggcctagcctgacagagctggcttcaactcattttggaaaagtactttggttccaaggacagaacttgacccgtagccctcaagattaaaaaaaacctccgtgagaggaaaagagacacatgaggcaagttccttcttttaagccaaaataaatcaagcccttaggactaccatgacataatatcatttttaagacagtcctacaaacccagttgagatatgccacgtgtagccttctcgtctgagttagatgagaccatctaaatgttgttagagcatcacaataatgcagtgaattgatggatgaattcggattataatgaagctagggatctcacaatttttgctcccagaagggatctcagtagtgctcttctgcttgacaagtgagaagcaaaattaattcatataatgcctatttaattatgaaatatgggcatgtctctgtcatggctactgtgaagggcagaaaaagctatacaacatgagctttacctctcaagaaacttaaagtccagttgaagagataagatattaaacaaaattagagtgaagtaagaataaatcatagctaacatccatgagcagtggctaagatggttgtttcttacccttatttaacatttacctttattgggaagggaggcagcataacattgtaattgccaagacagcagcaactggaggcaaactgcctggatttgtgtcccagctctgccaaggagtagttacccaagaacttaagtgagagctttgtcaggggacttaatttctctggtcctcggcttcctcatctgtaaaacagaactaggagttgtgactcctcgtgaaactttgtgaagattgaataaatcaatacatggaaagtgtttaacgcagttctcgacacaaagtaagtactaattaaaaatgctaataaacgttagcatttttaaactatcattatcatgattgtgactattattaccattatcactgttagtcaaaatgtggcttaaagagtttaagtcaattgcccaagatggagcctggctctaaatcttgatcaataaggcatcagagcacagaaaacagagagttaaacaatatacaaattgtgaattagtcaagaacagaatccttgaagcttagttatttttcttactgttctttccattcctagactataaaatagccctttctccattgcctgaaacatactttagaagctagttgaaaagtgttatatgtagtggtgtgtaggtaaatgcttaacagccaagtctctgggaaaaaaagtgtgtgtgtatacacatgcatatataatatattgcattttttagttatataaatgatgtgtagaacacaattaaaagtaaataacaattgaatatataatactgtttctaaaaaattccatacaatcacttaattgtcacagatactttcaatgattttggccaaactcttgtatctcgtatctgtggttgcaactgatgaacaactgtagttcccacttgatattcctttatcttaatgagtatgtcagaactttactcatttgttaatgacataagaaactactttgctgaactggataatagtttttgaatattggaagaatattttttcaatttttttgtgctattcacaatgccttgcaatacccaacaaagcaacttctcaaagaattaagaaaagattattaaatgagaaggaatatactaataccacaggtaatttttataaaggcagaacatcctatctataaataagcaattatatttagccaaagaggtatggagcacaagttaatattttgctaccattaggctacgacacaacatcctttttttgttgttgtttttaagaaatggaattttgccatgttgctcatggttggtctccaactcctgggctcaagtgatctgcctaccttggcctcccaaagtactaggattacaggtgtgagccatcgtgcccagtcacacaacattcttttaggttctatctgcaacattaacattttctccatcactttaagtttagcaaataagcacaccaatgaatcaagctctcacttgcagcatttgccagtttctgctgcaaatactcccacagtggccaatgtcaaactacaaagtgccatcactgaagagttggaaagtgactgcacatcattatatagtatttttatcatacaaattcagtagactcaatttcaagagcataaataacagtaaaattttgtaaaataattaagaagtgaggagtcttgttaaataaggtaatttattcaagtttaagtgtatataattttaaataatacctgtgtttaacaactgaccaaagttgctgaaaccttaataattacttcttgtaagccagtacaggttaacacttacacaccactggttatttgaacccaaaaggccaaagagatctgaaacactaatttgtctacatcgcacagctaattctttcatgtattattaaataagttgatagttttatttacttagcacgccacaaaacgtgttgcatattaccatgagttgattcatatctcactaccaatatattacctacctttgtatgtgcactaaataagcctaggagggttttctttgccaggcacctttgaacatcaagttcattgtacagtgcttaggattcaggctatggaatcgagctgtgttatttctcaattccggtctccacatactagctgggttttcttggactagtactataacctctctctaaatctcaactgccttacctataaagtggtaatgttaatggtacttgtgatggcagcggcggcctgtctggagcagccgcttcgaagattagcttcagtggggcaggaagggctggtgggagccaggaacagacaagagccccaccccctaaccagttgaaggggcgggagcccgcactccttggtgcagctgcagcttcccagccgcactctggaccctggcatccctgtgctctcaggggcctgggaagcccctgccccagcgggcttggaagtgcctgctcctgctcccgggcctctccctgctcccggtgcccactccagtgcagagcaaagttgtggccaagcccgagggctgtcgtgactcagctgcgtttgcgtgcactcagggcagcactcacacgctagcgccccctgctgccttggccccctccagactttgggcgtcagtgagcgcaggaagcagcagcccagggggtgctgagggcagctccctgcgggcctgtagacacccctcaacgtgaacagcctgggcaacgtggaaggcagacaggtccctgggcggaagggggtgggtgcccagtgaaaccccaccttcaagccagggatggcttgaagcctgggggccgggctgccagtgccgggtggagtccccctcctggagtgagaatttatgatgctttttccggctggcccatggcagcccatggaccaatcagcactcacttcctccctttgagcccatagacaccctccccactccaatgacctgcctgcagaaaggagctacatacacactgtgggtcttctgagagctattctgttgctcagtgaagctcctccctgccttgctcaccttccagttgtccacgtacctcattcttcctggatgcaggacaggaactcaagatccgccaatggccagactaaaagagatttaacacaaacagggctgaaacacgcctctccgcctaacacgttgcaggtaatgagaaggagaagagctgtggcccttcagggagcccagacctaggggctctccaagtcagggctgtgacgccctctttagggctctgtggttcctggcgtctcccagcttccaggcaccacagcattccctggtgcccatggtggaagctacttgcaggacgcctggtccagatgcagcctctcttggagccagcgcctatactggcacttggagctgcctgccccaccgcagccagcacacctggccgtgcgctgtggccgaaccccgtgctcactcacacaccccttgccactccatgcctggctcacccttgacagatgtgggatctgggccggtagtgccagctgagcgcagcctgctgggccaagtgtgtggaatgagcccagtgaggctaagcaaaactcaggcaaaggcgccacgggccacagacatttctgactagaaaactgacaccctaaggatcctgtgacacttgcattataaggctattgagagggttaaatgaaacaatgtttataaaatgcctgcatataattaatgccagaaatgtgatgtacacacacccacattacttggaggttatattacattacattctgattatgttctatgtttgaatatatgacacaaactaaatcttcagcaagaattaattagcagcaaactattaatttgtgctccatcatacttctttggataaagataattatttgtttgtagataggatattctgcccttattaaaactacccatgctattagtaaattccttctcatttgataatcttgtctcaatgctttgagaagttgtcctgttaggtgctgcaaggcattcactgtcaaattaggactggcccctaccatcttgcaaaagagacaggtgcccagtggacagtgaagcaggggagaatagagtaatggtcaggagaagggcatcatgaaaacctgagggctccaatgcagagagagtgtggggctacggaaacagtttgggctttaggagtcaggctgatttggtttctaatcacactctggactttagaactggatagccttgtacatgttactgatctttcctaagtgtcagtttttttcatttttcaaatgagaggaatataggacatatctcatacattggataaccattagcgtttaccatatattcaagaaatattaaatcctgtcacacactttgcctcctttctttaccatctccttctttttcctcaactcgtatttttcctcccttttttcatctctcctcaacctctgataggacagattgaaaaatatttgatggactaggcattatttcgtatcagccattgtatatgagtagtgttttaaattctaaatattgtaaattataagaagtaattatatgttaaataaagtttacaactccaaacatccttaatcacattgctagcaaaaatttattgatttagtttttgagatggagtctctctctgtcacccaggctggagtgcagtggcacattctcagctcactgcaacctctgcctcccgggttcaggcaattctcctgtcttagcctaccaagtaactggaactacaggtgcccgccaccacacccagctaatttttgtacttttagtagagacaaggtttcaccatattggtcaggtggatctcagactcctgacctcaggtgatccacctgcctcagcctcccaaagtgctgggattacggatgtgagctactgtgcctggcccaaaaatctttctatctttacttattaactactacttattcctaattttatgtagttaaaaaccacaacctatgtattattttaatgtttaccatgttgacttaatgctaggtaattaatatctttgcatatttctctctcctttgtacttacagttgtattaggttaccaaaagaaattatgatcacttctataatgtccaatatttagatggttttatttttgtcttctgttatataagtgtctgctaaaaatattttggaaccactgctctagatgatttgtaagatctttaacaactcttacattctgtgattgaattagttatgtaatagcccataaaatgcccaagccacagcccttccttccttttttcctttcgtagttctcctcctccctccctccttttctttttccttccctgcctttcataaatatttgtgaactgctactctgggccagatgccactgtgggcactggcagaactgggccccctgtagatcagatagaaacaaatgggaagctctgggccattgccttcaaaaggctttcttattccagagaggtttttgacataatcctcccctccccaccagcctctgctgtgaccagcttcttacttgaattacccttcagctccctcgctcagcttcatgctcagcatttgcccagactctgacctcttctccattgggatctttttcttggtctcttggttccagactcaccctcatccctaccttgccttttgttttcctcccaatttcttggcttctggctctagacaggatatggctgttcctgctttcaaacctgtctattattcccaacttaatctgtctgtcagtgacaccttctctcttgctttactgaaaggcatggcaccttaatctgtgagaggggtgggaagcttcagccttctacctggttctttagtttctctaacttaatccttcagaagatggcaagtctttacttttggattctggcaatgtggcccacactttcgtgttgaattacagtcatggtatgtagttttttttttgtttgtttgagacagagtctggctctgtcgcccaggctggagtggagtggcacgatctcggctcactgcaagctccgcctcctgggctcacgccattctcctgccttagcctccagaatagctgggactacaggcacccgccaccatgcctggagaagtttttgtatttttagtggagacagggtttcaccatgttaaccaggatggtctcgatctcctgacctcgtgatccacccgtctcggcctcccaaagtgctgggattacaggcgtgagccactgcgcccagcccatggtatgtagttttatctttgactttaaaatgttttacccatcctattatcatgaattgacttcttcctgtattttttggcagtatgttgagcacaagggttaattgtataattaatttcagaaagttaatatagttaatctccaaagctctctgttagtatgagtgagaaatgagtaagggcgtaactactgttataggtgtttagatgtcataatcaaagtcagggacaacattctgtaatgatccagagtatgggagtgtgagggacacactatgagttggtggctcttcataaccactattaatcatagtatgtttttttttatgacccagcaatgcaaccaatgttctcattttatttttcttggtattcttagcacagggcctggcatatagtaggtggttattaaatacttgataactaaatgagtgatgctttttcttatgagagaaaataaatgtttttagaagagtcagctttataccatggtttcaggggatgaattgtgatgaaaagtgaagattgcttttgcttgaaagaggctgactatttcccagacccaggatcactttctgtggtgtatgatttaagggtgagcgagcatgccaaagcgctccacttgagctgagtgatggggaatgagttgtagagctgtggtcttagatggtattttgtgaaaaacagtgggagatttatggctattaaacaactttgtagctgcccccttcttgtttcgaagtctgccaaatctctcctcctgtggtctgtatcaggttctttcagtgcatccaggacattcagagatatccaccggactgtagtttttcattgaatgcacctattggaaaggggcttgaattttatgcatttatcagttttggtaatcaccgagtgaaattctcgctttgcacgtctgttgtagaatacactgtatgtgcattgaatcttttccaagcgggttgccaaagttctaccttccttctttccattatggatattgcagagtgcagtatattagtggctactgcctttattgatgtgagttttaaaaattattagtaactctttgatcgtgagcaggagaagaatcaagtaaccttcagaatgctttgatgtatcttcagcagaaggatttataaggccagaatgagtgtttcaagccttgcgggggaaggggatacatatttaccatcatctgcttttttctattctagagctcactctcagtagctctagaagaaacagaaatgggatatttcatcacaaaaagtcaatcagaggtggcattcatccatgttatacaagtactagagaattgttacaggaatttttctctcattgtgggttcatgtcaatataggagtgcatggattagaaaagaaatagggccttttggtgtttttaaaaaaatttcaggcttaagtctgagaaattccaaaatgtagaaaacttttaaaaataatgaacacatgtagagatcatccagaatttgtggtttctaatattttgacatttgttttaagtcttctttaaatgaaagaaagaacatcatatatacagctgaagttcctttctctccacatcacactagccccagtcctactacactgccccttggcagaagcaaacattttcatgaatttagtgtacattttaaaataatttttaggtgtttccctgcatacatgaaatcaacaaattttatatttccataaatattatattacatttatcattttgcaacttgcattttcactctgtattaaatttttagacctattcaaagcaagatatagaaatcaggtttttttctcttaaatactaaatattattctgtcttactgatatacaacattatttttatttattttcctcatcgacagacatttgagttaattccaatttcttctgttataaataatgctgcaataaacattgttttatgtctcaatttgcagacctgtgtgagattttccgtagagtatatattttaagtgaaattgctgcaccaattttcaattttattagagattgctaagttactctttaaagtagttgaacgaatgtacattcccaccagcaaggaatgagaagacaacagtttctttttcctttgttctcactagtacctgctattgtgagacttaaaagtttgtcagtatgatgagtggaaaaatcgtatcttgttttaatttgcattgcccttagtcctagtaaatttcagcaacttctcttatgtttattgactgttcaggttttctcatctttgaatttccagacatttcctttgtctatttttctattgatttaaagacattctttttttttttttaaatttggatactaataatttattgtagatgttgcaaatatttcctgacaggagaatttaaaaagtaaaatgtaaaactataattccttgccataggcatttagaaaatgtggcaagagccaggcgcggtggctcatgcctgtaatcccagcccttttggaggtcgaggcaggtggatcacctgaggccaggagttggagaccagcctgggcaacatggcaaaaccccatctctactaaaaatgcaaaaattagctggatatgatggcacgtgcctgtaatcccagctactcgggaggctgaggcatgagaattgcttgaaccagggaggcagcggttgcagtgagttgagatcgtgccactgtattccagcctgggcaagagagtgagattctgtctcaacaacaacaacaacacatttgccaaggattcaaagatttaagagtctttatagtcttgaagattcatatttactcaaatttgcttattctcattttaggcatatcttcttaacccaggtaaaagaaaacattatttaaattttctattactgcatactcaatatacgatgggtgtactgcctcagtttcaaggcaagttctttattctttggcagatacagtataaatttaagacattttcttgtccacttctttcctatgataattgtgtctttctgaattgtacatctaatcctaaggttcagagaaccagtgtgaacatcactgttgaaaggatcacaagggcttcattttgaaaaaagccaagtcaaagagctggtagttggatcattgatttgtagttgttttcctaaacatccagccatagaagtcccaccaaaaggcatagtttgcaaaatcattctttcctggattattttccatgatgtgagtttatcaatggacactgagcaggaaagtaattaagtgctggtcatagaatgatgactgcaaaacaacagaagccacaccattttttgctctacctacagtacgaaacaaaactaaatatctcttttacgcttggttacagaattctaatgtgtagcacagtcagagatgtttctgaaaaggtagcatttgttccagtaattgtagaaaaaagctgtcatcaaattgtcaacagcccaaattgagattaaaagttctaagaaatatcactacacaacaaactaaaactcatgttggatttttgggtcttttttttagcaatgagatggagcagaaatattgacagctatggcttcctatggaggaagtatgatagatctagggaggatgacccctgtaccctcaccccatatgtcctgcctcaagcattaaatagatgccctatttaggacactatcctcatgtttcattcatcaggtagaaattacaggagaccttgaatacccaatagagagacacttggtgactgtagtatttgatttttaataattttgggctctacattcttgcagtgtgctaaaaagtggaaaagtcttacctactttaaaacacgtttttcttggtggttaagcttttatttttgtggacccaatagccttggatccaaatttaaacaccatatatttgccttggagctggagtgaagaaatgctacctgaaaactgttttctacctagggacagagcttctgattttgctccactcacactcttcctgtaagtctccactgaaagccgcttagtcaaacgtctcaaatgtcagaaatgaaatttaaagggtttttctagcaagtaggtctaatctcctacttagttttgattcctataatataggtaatctctttggagaaaaggcctgcttttagaagggcaaatatatcccatagaatgtatttcccgctccggaaagaaaaatgtagcattaatgaaatttactttttcatgaagcttggaaagattgttagcttcggattttgatcctagcagatgttctttttgggatattaaaaaaaaaagctacatttgatttaggaatctcagttaagagttacagcggtaatgcttcttgctactagcagctacactgtgagtgtggcatactggccattggttctgagtgatagctgaccccaagctgaagtactttcttttggctttagctcacaaggatgttgggttctgaaaagagagccttagcagcctgggccatcttggacacagttctatggttaaagagttgtctgcgtacagtgaaaaagcatcatcctagatgtatgttatgttattttcttttaggccttggagtgacacatttgttgataaccactacatcccaaatccaaatttcagacgtatttctcactgctgttgttaaactgagccagaatccccagtacacagcacaagacaatttatatcctttcctatggtgacttcattctgccaagtctttcatgccactgggctcatggaagtcagccctggttttccccatttatcctgggggcagagcttaacctcttcactagtatccaaagaaatctgctcatagccagcctttactttgtgggaattactgggtgaaggcctgatagaaatctaagcctttaacttttcctgtcttctgcctctctctttttcctcctccctcctttcatttcagcacataaactgcccccttttcttagagctattccatatgtactgaggcccctcaaagctttggatcttacccaacacttaccagaatattatctcaacaaaaacagctcttgcttcctaagaagtatcttggtgaataatattttctccaagctcagatcccaaggagacaggtctggtaaatgagggtatttggtatttggtgtttggtgttgcttcatgttgactttgcttttgtcacacaggcttctagtgaggacgttgccagctccccggagcgccactacacgcccttgccttctgcttccagggaactcaccagtcaccaaggttggaactcagctttttattgctctcagtgggtgcagggagggacacttggctgtgcagagctctggctcattactgctgcctcggcactttagaaagaacacagtgctttttaagtccttgatgagaaaaccatacctgtcacacgtagtgattttaacccatattaaacagaatttagtagcagtctattcaggaggcaaataaatctacggtataatataattttgtgatttttttttctttaaataaagagattagagtacttaaaaattatcaaggagatgttaactccagtattagtgatggagagaaattgggaaactcactaacatttataaaagtatcgttgtttgagaatataacaattaacagctataatttcaaaatgaatgaactctatgttataactaaaaggaattccaatttgcctggcaacattgagagaagccatgtgcagtttttgctgaattctcttattttcaaaatattaatttggtttactcagtttttccaaagccttgcatgtctgttgccatctctagagtcttcagcttcaaaagcagacagaacactgacatgaaatatcatttgaaaatgtcttatccctaagttggctgttttaaatattgtttccccaagaaggaaattccacttgtacacgtaaaggtgaaagtgaacaggggctattctagcattgtcatcccagcagcattgcaggatgagcaggtggaagaacaggctgtggtgatgctcagaaagtagtgaatctgaccctccaagtcaccgtctgggctctgggcaaatgggatacttgtattctgcaggaaacgaagaagagagtagtgcaggatttccgatgtctgtggcttggacctgtgttgcctgtttggtgtttgggcatcaatagaacttttctacatttaaatatactttagttaattttgtgaaaaatcaattttgctcaaagtcagggagaataagcagctgccaacctgctatgttttgaggggcatgaacaggtctctttcactgaatgtccttttgaaggtcttaagcatacatccctttcgagactgtttttgggggaatttccctaaaataacaccacatctagatggagcaacaaattaacccttaaattagcctcatatcctcatgtgtttatttattggtttcttgtatttgaataagggtatttttactttagagtcattgaataagttgcatagaaactgaagtctcagaaacctcacagccacttgtaaagtttatctggccctgaaattgagatttcactatggagagatatgatcagatagatgataatcattaggaatagggcaaatatcatctgtcatttttaacagtaatataaaaaatctgagacttgaagaaaggaaatataacacaatatagttttaaaatatttggagtaatatttggaatatggaaaaatgcctaaagtagttagagttcaaataagtgctcttggatgacatcagggcttaacatcaatgagagaaatgtaaagacgttatttaaagagagccaacacagacatctcaattttactgaagaaaatccctacacatttaacatgttggttgcctgaccagtgctgacttggttgttgataaaagcaagtccatatcataaaatgacgttctttgggctgatggccataaggagaccaatagagagaagaccgaagaagttcattaaagctggattattgaactgatctatgtaggagaaaggtgagactaatatatttcagcttagcataaaccaatttggcttgaaccaacttggctttccccaagtgagaaagccattattttttggcactaaaatgaaaccacttaatactatctcatttttttagtatttaaaagaattatttcaagtttctgatcatgtacatcacgaaaacatttgaatgtcatttgttaataccttcatgcaaacagcttacaaacatttatgcagaaggggacatttcatggtgtgaggacaaattacatcaattctttctcaagtgaaattctccatgatgtctgaaacttttgtctatacaatcctcagtggaagttctatttgcaaataattttttattcatcgagttcccaatctcttttccttccacaccaacaactacaaaaactggcgggcagtagttcatgtgcaaattgctatttttctgtacatgccattttccctttacttgtccttttatgtaacttccaatgtcaactatgataggtccaagattcatgtcctaaaaactgtagattcaaatgcaaaggaagtccgggcttagaataatgatcaggagacctgggactcaatttttccatctgttgcttgtagataatccatatatcacagggatagtaacatgtcgtattttgcttcctgcatgaaacttttactgatctgagttatgttgattttcttctttctataggtatgtctgatatttgtttctatcttctaggtgcaattgttcatattctactttgtatgatagaggtcaggttatgtgtatcttaaactcctcataaatgaaaactccctgagaggcagcagtaagtccaaatcatctttttttttttttttttgagatggagcctcaccctgtcacccaggctggagtgcaatggcacaatcttagctcactgcaacctccgcctcctgggttcaagcgattctcctgcctcagcctcctgagtagctgggattacaggtgtgtgccaccatgcctggctaattttttgtatctttagtagagacagggtttcaccatgttgaccaggctggtctcgaactcctgaccttgtgattcacctgcctcggcctcccaaagtgctgggactacaggtgtgagccaccacgcccagcctcatcttctctttgacatcagtgacactgcccattcttcaggtatcagcttacatatcacagctccaaaggaaacttgcctgataccccctacacacttatattaggccagtgttccctgttcagggattatcttcctagaaaggccataagctgttgggaagagtggttgtgattacatatgttcaccactttatctgcaatgcctggcacagggcctcctacctaaatggcgctccacatatatttgttcagtaaaggctgagtaataggaacccaggggaagggtgagtatcttagtcacctctgcgaggtaacttgattgcatgtgagaaaggagaccctgcttcctttgggggtgaacacactaaagggaaaggtccagctgtgtggacctcagacctcaattctgttgctttcataaacccaaaccatcagggatgggtgtcatatgtgttcattcattaccagaaagcatttagtcacaaagcctaacttctagatagttgattattttaatgttgtagttttcaagcattggcggtttgacggtagggaagggaataggatgaattgaagtaactgatggaattattttactagaacagaaactctcaaggaaggggtcagactctcagtaagatacagattgtggtacacacatggatttagaatggtccacctgaattctttctgagaatgctgccctgggttggagcatatctttggaatgaggaggacatgggaatgtgtcagtaatctcagttgttccctcgtggcaatctacatattgtatccttggctgtgtccatgttatgaggagcgctaaaatatctgttggagaaatgtccctttaaatatattacgagtacaggacatgccccagcgtgccaggtattgccgttctttatctggtagctcttagaagtagaattcacatttgtacagggcattatgtcttttggggaaaacatttctatttagaatgtaaactatatcatcctcagggtaaccctgtaaagtgaggagtgcaaatatttttcccatttaacagagggagacatcaagaattgctggggatgatggagcaactcaacaacaggcaagggaaacaaaatcaaagccctgtgcccttaattctcaggtccccctgacctttgtcctttacccagtgcgtatgaagcaagtgtaggtaggactaactgtggccttgagctggaaggaagagtcaaaaaagtagagggagaggcatggcctggaaatgttcaccactgccatgcgtttccaaagcctgtgctaaggctgctaggagctacagcatcccacttgcctgcctctgtcaaaagaattgcattactcctgccctgccattctgtatttttaaattacagaacaataaaatcaggagtggagaaaatttgaaaacaaaaagggtgaatgctccatgtcagtctggattcagacagggaaaatagaaggcactgtatgtattccagtaatgaagagttttaatggaaggaattagaggtgctgccaccacccagagtcacaacctcagcactgaaccagtgattctcaggagcttgctggaaagtttctgtggatcacaggaacatctgggtgtctcccactgactttctctatctgaagcaccagtgaggggattctcacgttcacctggagactgtttcagtcattgctgttatccatgcgttgccctgctcctccatctctctagatttccaaatcatactccagcatctctctttggcccaactctaacctaggctgattcactgaaggcgattctccgatgtagttttcagttctccctcgaagctacagagaaaaccttagaagaaagcagatggtggtaatggtaaaacagataatccagcacatctaccataaccctgccttgccaatagctatcatgtggaggatctcatttcaacttgtctgcacgcacattttgcaagataattgcaagcctagtgaatgtccctgaattatttatttcctgatgcttatactatagtcttgaagatatgccatagttagcttgccatattaaacattgaacttgaaatgtgtaaaagaaagaaagcaaaaagaaaaaaaatgaagaggaaatttgctgtgaaacttgcttagagatgataacctttctactttgactattgttggcaatcttgccattatttttattgacacagttgttaggtactcatcttcctctccaaccaggggcttggtctatttgtgtttgaaattgattgctgggactgtcacaaagtaatttatatagcaacttattataattagttatcatttgcagtttcctaaatgtgagttgcattttatgcttagcaattgatttttctgtatatctccatgaagcagctcaatgtatgccatccaaaaaagaagaaaaagaccgaaagaaaaactgtgtttttttaaattatttaaaacatttttagcctgagatatcataaaatacgtttccacagaagacataaatacagagtgttttgcttcaactcattaaatcgccaaagtgaaagtgaataaaaggaaatttaaatgtctgtatgtgaagaggtagcaatgtagacaaaaatgtttgggatggggagatgttggccagaaaaacttcatgccaacaagcataatgctttcaggagggctcaaaaggaagttacttgatgactaaactattgctcacaatttgttttgggcttataggattcggaggtgcaggggcagaatgatgcgatacttttcctcatctattataagggtcacagcccataacaaaagacaggttaacaagagaagaggataagaaatttacttaatcaaagttttctgagatgggggggcctttagaaatgaaagggaaaactagttttatgcttatgttgatgaagaatggacagctgtgtagaaacatggttagacaaagggtatgatctaatgggaatagattgaggggaaacctagcaaggcctgtctgttcagattcttcttggcctctctatgtagcattccttcccctggttataggacagaaccctctgaaatgagagtcttcaaaggagaagagagagtgtgaattttctaggttttatggctggctttaagggataggattctagtttcgatgaccccacttagggaagaggaattctggtttctataactcactgcagggcagagacagagggatgagggagcaggtaagagaaggccagagagaccttgcttctgaggcccttccagtgtcttttgtttcaaagcactcagcacgtcaaggtgccacaatttcgggtattgtgttttgagccctgtcagaggcagtatgtctcttttagccaacttttagtttttcatttttagatttctactatcttttcatgtcagccacagggaatgtgaaagctaagtaggtctgatcattataaacaaaatctacagaaaacaatagcaaagactcaggaaaatagatgcatttatttaggccagcttaatagcttagcatcaaggaatcttttgcctactgcctcttggttatcactgaccatttataaacatgaggccaggtgccgtggctcacgcctgtaatcccagcactttgggaggctgatgcaggtggatcacttgaggtcaggagttcgagaccagcctggccaacatgatgaaaccccatctctactaacaatacaaaaattagttgggtgcagtggcaggcacctgtaatcctagctacttgggaggcagagacaggagaattgcttgaacccaggaggcgaaggttgcagtgagtggagatcgtgccactgcactccagcctgggcgaccaagtgagagtccgtctcaaacaaaacaagcaaactaacaaaaagatgggatgaacaacctgatggttctggagcctttgccacataggtctcacctaaggtcaggccctatgagtgagacagcctgcttatatattgccttctgccttccagaatatttttattagtctttcaagagagctaagcatcaaataatttctcaaaaaattgtcaatgactcattgaaagttcatagaagcacaacagatccaaatttctcctgtggataatgtattgaaaagtggcaaaaggaaagagagagaaaagaaaaaagaaaaaaacctccttagagacaagaatatgtttttgtccaggggtcctgtcaaataagagtatggccttggcttgtatcttttagacttcttgccaccactgtgccttgactgtgtgggggaagagtgtgttggttcctcgtgcagaactattattagcatttgctaattatgtaaaatgatttcctctgatgacattttcaacagaacccattactttagttttctttccttcataatgcttttatgggcttataatcttggtggaattctcagatgctgagagatgctaaagtttcctttatttaatcgaggtgactagtgatttgacagtagtggttgacaggtttattttatctgcgtggcagtaggagtctattttcagtgtgtgcactctgttccaaagtaaaaggactttactaagtgctgaataaattgtactttcctttgattctagaccttgctgaaatggtttaaaaactccggtctgggtcatcaaattcatctccttgctactttgcagggtcaatagcttcactctgtacagagccgggctgggtggattggaatggagggtagtgtagattaaaacttccgcatatatatagatagatgtgcatgtgtgcactcgctgtctgcgagggtggcagtgatggaagagcaagccaagtggaattgaagatggatgaatctgttagactattaccaagactggcatggagtttagccaggaactttaagcaacctcctttaaacatttgaaatccataggggtccatttcctctccttttcctccaaggatgatttttcatttgcagtctctgagattgctttatttctattctttgggcagaattgtggtatacttgtagacagagaagggctacgaatctggtttttctctcccagagcaaagcaaggaggaaaaaatggatttcagttttcccctgcccctcaaatagtagcaaaccctacttctgtaaaatgagaggtcagaatgacaactcttcccccaacagacagtcccaataaaaaatgatagtaaaaacatgctccctttatcttaacaaaatggaagcctagaatgtacagggtggaaggttctaaatgtgcttatgttttagagtcctgggctgtttcttgcccctttttataaagaaaaaagtatgatatggtcagtaagacaaagattgctatgagcacagtcattcaagaatctccccaacatgtcttcatttagtacctattgtgtactgagtgtattgttaggatttgtggagaattcagaaatagagaatattatctctatcttctaggaatttatggtttgattgaggagatcccaaaaatgaagtaataccaaccaaacaatatattatatattacataaataagagctctattagttggtaaaagctgcaaatgctctcaacgtttagaaaagatagcgtgcaatgtaggtgagactactcaggcatgactctttggaggatgttggcactgagctttgaagaacatgttaagtggagagcaaaagaagggcattccagaaagataaatgggtaaagataaagcacaaggacaagaacaggtagaactgatgagagaaagggaccctgttttgaaaaggtcagaaataaggttccttatgtaggataggtccacattatggcaggccttggacagacagaagggtttatattttatttaaaaccatgctgtaggattattaatctgcaagcagtatccaggggtaattggaaaggagagagcctggattcaaggaggccatggtgggatgggattggaaggaaattgtttcagtcttagaagccttagatttccagataaccaggttctgtgcccatagactgtgatgcctccaaagagcaggtttctagcaaaggtaatttagaaaacaacttggtaacagatggggaagacagctggggcctggatagatactgccaggagagcaggagtgggggccatgcacagggaaccttatggccactatggagttgttgtatgaggttgctgatggtttggtcacgagggctcaggcatcagagaaactggacagtcagtgtttttcctccgcatgttattcagaatatttctgatgttggcttttgaaactaaaacacagggcccaggataatgttacaataatccagcattcgatgatcaaggcctggagtggctggctggctgactgggagtacaaaaaataaaggaaggaatatgagaaacattctgttgcaaacacaatagaccgaatactgattatatttcagggtagagagaaacagaggaccagaaagctataaggaagccagcatggtgtgtgggaggctgtggtctctgcctgttgcccctctgtcggttcatcctcatcacaggattctctcccaccattcatgcatgaactctaatctggcctgttaaatggaagaccggtggagttaatgtagtggagctgtggcagcaggaacaaacgtacaaaaagcaggcagagcagccacaaacatttgttctcattctagcctttggcttaaagatgagcttcattctcttaagaactaataaatgtccagggtgttttatttctgaatcttgggctcctggaaggagagtgatttgaagccaatgcttttggtctaaattgttcagccgtgagctcggcccagtattaacttcctagtcccagttcttctgactctttttatttccctgtctcttgtagaaaactttacccctgccccaggtttttcctcatgtagtgattttacaaccttttttggaacaaataaacaaacatctggaatcatgtggcacatttaattaaaaagtttgcatttggccagaaatggtaaaatcatgaaaaatggcctgtcggtgagctcaagaaggccaaatgatgacgttgttggctgcaaacggactgaaattgagggaagtgaacacctgctcagctcggcctgccgtcctccagcttcctcctccagccattaatatttacagcagtttctttatccattctaatgaaattttttggttggggctggtctggggagagggctgttacttttccaataaccttggatttgttgtgatgtgtgtactttataaagggtgtggtattgggctttttgggcttttcatttcccttgctcagaattccatatgcttcaggtcactgcaggggcctgttgctgtttcttcaatcagtcactcaaccatggttttcatgagagccgtaacatgtggaaccctgcaccagggcatgtaggagatgaaaaagaagctgtgggctctgccttcaggaatcctacagtctaattggagacaaggtcctatgcagagaaagcagaggccaagctagatggaagagtgcagagaagggagggatctgtgatgatagaaagattgggaggtggccttggatgaaggtgagaactgagttgaaagaactttccctgcgtgagttccaagtgtgaaaggatttaggaagagatcaagttgtggattcttgtctagtttctggtcataatctaggtgaaagtagggggtggatcatttaaagcaagaattagatatgattattctacatttccagttagcttctcctttgcaagacatagctagggtgaagtaaaatttaagttttgtttgcaaattaggataaaacattaagatgatctggctttgcagagtgtagtgctctcatatgtctcccacatgaggatttataccgaggatgagattattcttaggacaaagtgagaagtttttcttgttgcacagaatacaagggaagtagccaggtgctgcaaatatagtaagcactgtttaggttagatccaaaggaagtatgaacccataggtatctgagacatgtctcacaataaatttagaaagtttattttgcaaagacttaaggatgcgcctgtgacacagcctcaggaggtcctaatgacatgtgcccaaggtggtctgggtatggcatggttttatacattttaggaagacatgagacatcaatcaaatacatgtaagatatacattggtttggtccagaaaggcagataactttaagtggggggagcttccaggttataggtagatttaaaatttttctgattggcaattggttgaaagagttgtcaatagaaaggaacagctgggtgatataagaggttgtagaaaccaaggcattatcatgcagatgaagcctacaggtagcaggcttcagagagaatagattgtaaatatttcttatcagacttaaggtctatgttgatgttaaatgctggttggcttttcctgaattccaacagggaggagggcataatgaggcatgtccaacccacccccgactttccatcatagcctgaatcagtttttcaggttaactttggagtgccctggccaacaggagggagtctattaagatagttgagggaggcttagaattttatttttggtttacagaaggatgagtattgttttgaactagggtgtggattggcaagggagatagagaaatcaccattccccaaggccttttactgaaggacatgctcatctctctttgaggtagcctgaaggaagtgaaatgaaacttaaacaattttcaaatcctgactggatgtaatcctgggttctctatgtcagtgctggttcagctttttcataaaatgaaatcagggtttcaccttgaccctcctggacttgtgcaagcacagggagatacaggatcatgctggacggagcataacttcagttgccagaggagttcttagtcctcagctctttattattcttgtgcatctgtttccttaaatactctctgcagaagcattagcatgaaaataaaagagtacagcaacttggaattttccatttgtagcttccttagtctgtggggtcaaagttctgtcctcagggatgctaatgcaaactctgtgtgctgttccagggcaaatgtttctcaactaaatgacaagagggggtggggagccagggaaataatgcagtgctaattcccaaacacagactgcccagaggtcccaatttaaattgctgcttccccaactctattcccaccctcccccaaaggaaaaaaaaatatcctgtgttgttaggacagacatctgtgtgagagcaataaaacagtcttctcccttgtggattagctctttattcctttatttatcttgctatacctcatcagtttatcctaaatcaaggagagtcaaagaggataagatgcagtcccttttttgtttttgattaaggaaacccatacaaccatcctcctacacaaatttcttttctcaagagatagctttccttgttatgtctaatttctccccacccccctttttttaatctgcctccttggaaactctctggaacttttatttcatataatgttcaaatcagaaaatgaaactcctccagagacaggttagatagggcagtgaatgttggcatgtctgcatgattctaaagtacaaggggaactaggatagcagacttaacatattccatagcctccatttcttcttccaaatccctggaagtttattaattcattcaagagatatctatagagcatgttctatgtgtcaagccctgttcaaaacattagagatagagctgtgcataaagtgggcaaacatttctgccttcaaagagcttatgttctagtcagagagaggatctataactaagataaaaataaaaccaccacatggtatatcggtactaagatgaaaacgacagcagatcaagggcatgagagagtatgtgttggcaatttaagatctgacagccagagaagtcaccactgagaagatgatggtggagtaaagacctggggaggtgaggcatggaaccctgagaatgtctgagagaaaagtggtccaggctgaggaaggagcaagtgcaaggccctgaggtgggagcgtgctcctggcatacatgaagcacaaccaagaggtcagtgtggctggagttagtaatctagggggagagtggtagatgaagccagaacaataccaggggctagaacttgtagcccattgttaaatgttaaacccaggagcattaaaattttaaagaatttatttgagcagatggtgattcatgaatcaggcagcactagattgcacgtggttcagggctccaccaagagggtgtgagggaatattttttataaggtgtttgtggaagccaagacaaagaaattatttgattggttaaagtggaaagtcccagttagaagttagttagtggtttcttgttggttaagcttaagtttcattttactgcttacattgacttgggttttggtttgcttatgtaggaatccaaagtgctggaaccatctcagcctaatggcttcctgatagattattttaacactgtttactgtgactaagacaggaagctatttcaaggcagaagaaataatagaaatgctgttacccttctccttatagaaaaaaaaaaaaacaattcccaaatgaataactaactggaaaagaaagaaagggtactgcttttgatcagaaactatagatttcctgcaagatcacagcccaaaacaaatgcaacagagtttcaaaatgcagaaccaagacccagcagggtggcatatacctacaagctcagatatacctgacgtaggaggactgcttgaatccaggagtttgagactgtagtgttgagtgattgagcctgtgaatagccattgtattccagccggggcagcatagtgagacacagtctcataaataaataaataaataaataaataaataaataataaataaatggatgtagaactagcttcaggagttctctaagcacagagaaagctactgggggcctcatagcaggcaataatttgggcttcctcagtgggtacagccacatgggtcacattgtctgtatacttctctccatccttagtttaggcatcaagtaacagagctatctctaagccagggcagtaagtatgagtgattggatcagaaaaataagatggcaagagttggtacaaatgtattaagtcataataaatgagaatgaactagactaaaagacagagcactaccagatttggttaaaaaaaaatgtaaaataaaatactttttcaagaggtgcatgtaataaaatgacatagaaaacttgaaaatactggaattaaaggacagaaatactggatacctgctaacacaaaatccaggaagagcaatgttaatattagacaaaataagactcaagatgattactgaaatgacaaagagggttattttgtataactatgaagatataatgggaatctaaaacaatcatgaatcttaatgtacccaatgacatggctttgaaattcataaagcagaaacttctagaaataccagaaaaaactaacaaagtcaccatcatgaagactttagcacatctcctatgaaaatgacagctaaatgaatggactttttacaataccttccttttgttacatggaaaataaggtgatattctttaaaaacctgtatgaaacagtcacaaattggctcatatccacaaactggctcataaagaaaagtgtaacatgcttctttcaaattaactgaccataactaagtcaaattagaaattatattaaaaaaggaagacttccttccccctccttccaaaaaaaaaaaaaaaagtaaaagaggtaagaaaaagaactatagactacagaattagaaataaatgaagttttgggtttatgaggaaatagtatacagtatactttaagagtaaatggaagtgataacactgtagtatattaaaaactgtgggatataccaaaagtctaattaaaggatttttcctccttagaaacataaactgtaaaacaaggaatagaagataaaaatatatgaactatgttttcatatatcctaattaaaaaaccaagcaaacctaatgacacatggaaggacttaataaaataaaaacaatgtacaatatactttatcaacaataccaacagatatttaagaaaaaggtgagcctagcagatcaaagtaagaaaaaatagagattgacatttaacattaggaataatgagacaaaaaaaaccccacaaagctattgagcttcatattgataaatctgaaaatctaagtaaaacaagtaattttaaggcaattatagttaccagtgctgtctcaagaagaaatataagtctaaacagagaaaaaaataagatgataaaagaaactttaaaaataaccatatagccctcaaagagaagtagcatctcatcttttataatttattccagaaaataaaaaatatggaaaattactctttttctcttactaggaatccataactgaccctaagcaatgtgagaaaacatgaaaatgaaactctaggtcagtctctttttcaaatatgaataaaggaatcctccatgagaaattaacaataagacttagtaatgcatttaaaaaatagtacttcctgaccaagtagggtttatctcaatattgaaaggttagtttacttttagaatttatcagtaaatgtgtcatattggcatattaaaaaagaaaatgggattatatataaggatgatgttactagttataaaaagagagggaggccaggcatggtggctcacgcctgtaaccccaacactttcggaggccaagcagggtggattgtttgagctcaggagtttgagatcggcctggccaatatggcaaaaccttgtctctactaaaaatacaaaaaatagctgggcatggtgatgcatgcctgtagtcccagctacttgggaggctgaggcatgaggctctctggagcccaggaggcggaggttgcagtgagccaagatcgtgtcactgcactccagactaggtgacagagtgagaacctgtatcaaaaaaaaaaaaaaaaaaaaaagagagagagagggagaaacctatgaaatttaacaaccatttctgctaaaatctctcagtaaacacagaatagataggaacttccctaacttgataaagtgtatctaccagaaacctatagcaacctgcatatgaaagagggatttaaaaaatttccatcaaagtctcagaacaagcagagaaggactattctacattcccttggatgtgctagccaaagcaatgagatatacaacaacaacacagagcgcaataaagattggggtaaattcagcattatttgcagtcaatattatgacttagaccaggagtaggcaaactttttctgttaaggagcagataataagtattttagggattgtaggccagaagacatctgtgacaattactcagttttgccctaataacataacagaactaagatccattatatctgtagtaaaatatataaatatgcttaattcatgtattttaaagattttcagagtgaattataaggcaaaacctaatgctctgtgttgtggaagagaaacagaaacaaactgactcaggaaagttaaaataaaaggatggacaaatgtgaataaaaagaaagcaggtgttgtagtcgttatagtgttttacaaggtagaattcaagcagaacagtaaatgaggcaaagaaagatgcctggtactgaaggttgaaattcatattagaaataactattacgaatagctatatagcaaaataaagtgccaatattcatgatggaaaaatcataggctatgaaaggagaaattgaaaaatatactagtcttaggggattctccttcacctgtctcatttactgacagattaagtggggaaaaaataaggatatgaaagacaaaaatagcaaaattattaaggtagatttgattaaaacatatcaaactctgtaccctaacaatataggatatgcttcttttcaagtcaacataaacactcattgttattccagttagtacggctgtgtaacaaattaccctcaaatttaattctatgaaagaatgacttattatattcagattctgtgggtcaggtatttcaagaaaggatagtaggaatggcttatctctgtaatgcctggggcctcaataaaagacttgaagcctgggagctagaattatcagaagattcatatgttcatgtttggttgttgatgctggctgttggctaagggcccccctttccctgcatgtgggcctctccatgtggtttccttttgttggctcatttgggcttttcatagcctagtagcagagttctaagggtgagagtcccaagagacaggaagacccaggcagaaataatagaatcttttatgacctcagaagtcatacagcattactttggccatattctgttcattacggtagttacaaaagtcctgctgctcatgttcaagggaagggcaaatagactctgcctgttcatggggagtggcaaaattctggaagagcatgtgggaccagaagtattgctctgactgattttggcaaatacagtattccccggtaatatactgactggatcacaaacaaaatttcaataaatttcagtagatagaggtagtacaataacactgagatcataatataataaaaccagaaataacaaaattagattgcaaaaaagccctctacccagaaattttctagtactcttacatttcaagtcagagataacatatatggttaagaattcctgggggattaaaaacaaacaaaaaaaagataacatataagcctaaactgtagaatagctagagaagtatattaatgaaaccattacctatgagaatgtatagatagatttaagataattattagaggaaaatagatagcttgaagtacatatattaacttgaaaaaataagcaaaaattgtaaaagatatattaagcatctgactcaaaaacaatatcagcctcataaatcaaaggaaagtggaagggaggaagttttaaagttaaaaataaatattaataagatagaatacaaaaagtataatagaccaaaagttaatttttttgaaaaactaaattattaactatcccaatcaaggaaaaataaagaaaatgcaaatatacaaaataaaaaaataaaaagccatagaaacaagagaaaactaaaataatcctaagaagaaactgtgtttaattctgtgcaaatatctgaaaatctacatcaagtggataattttgtaggaaaatataatttcccaaagctgaccccagaagagatagaagattgaaacagtttgatttccacaggcaaaataaagttcataaagacctatcacttctcccacaaaaacaccaagtccaggtggttttacaaggaaattttaccaaacattagaagagtagatacttatagtattctgctaaatgtttaacaaccgggtctgggggctggagcagggagtaaaaaaaaccctgatctgtactgtttgctgatttctaagcataaatatttctgtcataatttatttcaagctacctgtgtgacatcacttaaagtgaagatgagaagagatgtgcagataggctgttgtgagtcagtacaagctggcttttgcataacatggagctgatcccaatgctatttaaactgttgcagggtatggaagtactactttactcttacagaagtatatttacagagtgaagaagtacttccaaatttcttttgtgaagtacataaggcctttacagaaacactgataagggctttatagaaacactgataaggattacagagaaaataactgcatactcactccaatgttaactataggtgcaaaaatgctaattgaaagaattacaaacagaatctagcagcataaaagcagagtaaaacatcatgtccaagtaacatttattccaagtattcaatgaaatttcaatattaggatactcatttatttactttttttagtagatctgatgatgaaacccataattatatggatgccaaaaaggctttggccaaaaattttatagccattcttgataaaaagcattcaaaaatagatgtgtacttccttaatatgaaaaaacacatccatctcagtccaaaagccaacatcaaacttagaggcgttcctgtgaaagtaaggacaaaacaagatatctgttactacctattatttaatgttttactagaaatactaaccaaagcaattagatatgagaagagattacaggcatcaaagtggaaagcctattataaaagtttcatgtttacaggtgattttttttttttttttttttgtgagatggaatcttgctctgttgcctgggctggagtgcagtggtatgatcttggctcacctcaacctcagcctcccaggttcaagaaattcccctgcctcagtctcctgagtagctgggattacagacccgtgccaccacgcctggctaattttttttggtatttttagtagagatgaggtttcaccatgttggccaagctggtcttgaactcctgacctcaggcaatccaccctcctcagcctcccaaagtgctgggattatagatgtgagccactgcacctggccaggtgatttttgcacttggaatttaagggaaacaactaaaaatctaaaaaaataattcagtgagaaagtaaaatatacagtgaatatgcaaaatctttagactttttatattgaaatgaaagcctgttagtattttgaatgaaaaacttcatttacaaaagcaacataaaagataataaattgggaatattataatcaaacattaacaaaaatatacaatatctccaagaaaaaaaacccacaaaaaccttctagaagggtgtgcacaagaattcttgacattaagaacagacattcgtattatttttaaggaaaactcaagatcataaatatgtcatttacctctttgtaaatttataaattcattatgaaatcatgtaacaaagctttttttcttccgttttaaactagaaaaactgaatctaaaggtcatgtggaaaatatgcaaagataatagctgggattatttttaaaaagaattataatgagggaaaatcagccctattggatatcaaatatattatggaatgttaataattaaaacaatgtggtactggcacaggactccccagaataatggaatagaataggtagtctagaactagactcagttacatgtagaaatttgtatatggtaaagtagtatcttaaataggtagggaaaagatgggccattcagtataagtttgggggacatataataggtatttggaaaaaaatttagatacataccttacaccttacagcaggatacgttgcaaatggattaaaattttaagtgaaaaaaaaaaagaaatcatacaagtactgaaaaaaaagcataagataactcataattcagaaacccagatataaaaagcaaaaatggacaaatttgactttattagaaatactcttgattttatttaaaaaaaaccttttacacaggaacacaaaaccttttttttttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgctaccacgcccggctaattttttgtatttttttttttagtagagacggggtttcaccttgttagccaggatggtctcgatctcctgacctcgtgatccgcccgcctcggcctcccaaagtgctgggattacaggcgtgagccaccgcgcccggcccacaaaaccttttaagcaaagtcaaaaatgaatattgaacttaaaaaattatttggcaattgtattacagaccatgataaatttagatatatatttattttatatatatttataaatttatatatataaataaaagggaataaaacaaggtgtagaatagtatgtatattatactgctacttatgcataaaaggtgggacaataagaatctatatttatgaaaaaactctgaaagatgcatgataatagtgacaatttatggatgggaaacctaggcatggaaaaagagtatggtggggaaaagacttaaccttacacgtgcatttactttaaagctttggaccatgttcaagaataaacaaattgaattttcaaagagcaaaataaaattcatactgccaataacctaacaattacacatggctaaagggaaatacacagaatgatattcattgaagcatttttctagtagtaaaatacatacaaaaattatatgtctgtcaggaaagaaatgattaaaatatggtaaatttgtaatattgaaggctatgcagcacttaaaaaaggttaaggtaagcaaaatactaatataacagaaagatctccaagacatatttttgagcaaaaacatgtttgagtgcaaaagatttgtatggtgttggcagaacttatttatttaagagtacagtgctatacacctttttgtgtttaaaagcacaaaagtatacacacatgcagacacacacagaaatctataaataattggaaatagttttgaaagtgtagacacaaaactcctaacaatagttacttctacgagaggactttgtttggagtggaagagagtggaagagggtgaaaaaggacttcagatttttcagtattggagtttttattaaaatatgctaatattttactcatgcaataataataataaaaagtctcaaagaaggtgataactttgggtgatttataactgttttggagactttgcaaatttgtttccccaaggccaagtgataaattgtttctgtgaaaacatcccttttcttcttcagatttaaatattccagtgttgagaatccacagtaaacttgctgtactctgtcactgttgaggaatgggacattcacatgaatcaaatatgctggtaaataaagaaatatggagaaaaatatagaggtacgtgcatatattgtatggcttataatctactgagaatggagaggaagacatcagcattaaaaatattctttattgagtgaattctttagatccaggcactgtactggaatctttacatatgtttgtgatctcatttaatccgggaaacatctcataaagttggatattatccccattttatatatgaggaaattgaagcttagaaagatatttccttgtttacccaaggtcccagtgctaataagtgtcctccatgagacgcaaaaccaggtttctctaacacctgaagcctgtgttctttcctctgttccattctgccccctccccaatacaatacacaacaatacaactacactgaatacattttaatgtttcttgatgattaggagagcacttctggcttttttgaatgttttggaatccctttatgagcgtcaattatcagaatactagtgaagcatggaaataatgtctaattggagatatctggttaaaagaaagcagagtaatactgcatcgacagaatttagtgcttttattacagatagataaaggtatggcaaaatcactggtgtgattcttgcatatcccctttattaattgatctgcatgttctgaaggccgttattccctatatactgattccaaatgttctgtctttattagtccttttatataaaaccttgtatctctatttgtcatcctaaaaatattgcttaaatacatgatgcagcttctctccacattggaatctgataacgaaaggtcttatctctgtagcctgaattaacatgagcagaatttaggtatactacgccaatagcttcatggacagtccctttggttatagattataaatgccatttagagaaagcacaggatggctcctgagtgtctagtaaacttcaacaaccacctgagagatacctccgtgtgactgcatgaaatggaaataaagaatggcaaataacccattgactatgcactttctcacccgctgagagcaaaacataatccgatgcaattttagtacttacatgcctctggggaaaatagacccctaaaaatcaccgagtgcagcactggaaaaattccttaaatttgtgctatgcttggtgttataaaacccaaggaaccttagatgttcttcttgagtaaaatggactggtaattttgttttgttatattatccaccaagcataatgataatgggtcacatgcaatttaagaaaaaattaagtctaataagaaaaatctctaataaatactaacagcatcttattggtatcatcattggtttaacccttctattaacatttgtttttttacatattaaatgatctgtaatatgttgaaaatgaagaggatagtaaaaattaaaacaggcattctaataatatatgcattgtacaaatgtttgcatgcttcttccctcaggcgagtactaggaggtgtggtacatgcatgggagtggtgctaggatagagcaggagattttgattttagatatgctgagcagtgaagatgctcagtgcaggggatagaccccatcattaaccaggaatgcaaccaattcaatgaaaaacagagattagaaatcaaaatgtagccccgaggaaagtacacagttatcccctcaaatcaggcttcttctgggccactgagaaagggtgaacgatcttagggaacctctggtacccaagcaaagggcctgggggctcctgtgcattgatagctatccatcacgggcaatgtggtagagtggggtagagctagaaggatgtattcaggaagctgccattattagaaatgtgcttctcaagcctacataagaatctcctagggaacaaccataaagtaaaagtgcttaagcacgtatttccaaggattctaattcaagggaactgggtaacaccctggcatctactgtttttaatgagttgttctggtaacacctctgcatgtaaacatgtgaagacgattgcattaaatgatattgacaaggagtctctttcccctagtcctttccaccatgtggtttaggagaatagcaactatttccaaaccctactgaatagtggcagccacaaatgtcttgccatgtcaggctctcaatggtttctgagaaagattgaacagccttcaggaggctaatctatgattaggtatttgctatgcaagacactgtacatgtgtagaaatggcaaaggtccctgcctcaaggaacttacagtttaggaggacctagcagacagaaactcagacaaataaatgcagcaaactgtgacatttgctgtgaaaagccatttgtattggataatggggacaaatggggtttggtcattagctgaagggttgcctaggtcagcataaggcttgcacaaaggagtggcagatgaggacatcacaggagccgtgttgaggaggtcaaatacttgggtagtagccacatgttggttgtaaatgtgtgtaggagggaagagcatgaaataactcccaggtttttctggcatgagtgtctttgtggcaggtgaagccattgtgaggatcagcatttggaagaactggatttgaagagaatgttgaatatgaagtattcatagtctgtaaatggagatgttctaatttgtgggtcagcaaacttttatcacaaatggccacatagtaggcattttaggcattgcaggtcagtctttgccatgaccactcaactctagcattctagtgtgcaggtagtcataggcaatatggaagccaatggggttggctgtgttccaataagactatttagaaaaacaggcagtgggccagatttggcccatgggagctagcttgccactcctgctatatgtataggtatgatctgaagataaaaatataaatgtagctatgttgactcacatacatacatatatatattatatatatttacctagtatctttctatgtagacttataatcatacctatttgatataaacgctgcacttcctggttatttgggataaacagttttttcaaactatccaaaagtcacctaataattgtctataaagaaacaattaaatatgaaaatataaattaaaacaacaaaatacattttgtactcagtggttcagcaaaatttaaaaatctggtgataccaagtgttaccaaggttgtagagcaacaaaaactgaaaagctatttcaatgggagttgtgaattaatgtatctctattggaaaacaattgattattttctagtgaatttgaatatatatgccaatcctaagttccagaaatctcactcctgggactctaccacaggaaaaactattatacatgctcagatcaatatgaactatactcatagcataacaaaacaaaaaaacagaagccggaaacaacccaaaatgattcattaaataaagtgaaataacattcaatatggacaaatctaaaaatcaaaagaaaaagaaaccgactgaatgataccatataatatcctttatataaagcttgaaagtgccaaacaaaacactgttgtaaaagggtccttacatttttggcaaaactaggatgaaaaccatgaaaatgaaaaactcaaaatgcaggtaggtggaggcaaaaaacaaaaaaaaaaataaataaattctgacctgataggaacgaccaatgggatttatttatttctaagcttggtaatgggtagacagatatttttaaaatgatagctcttattattttacatatgttatatttgttccttaacatcaagcaagtcttgcatgataatgaaaaggcaaaaccaaaatcttattaagttatcaattttatattttcaaaaaataattaagtcaagtttattcttttgttcaaaagaaacgttcattatggggaccgattttttttttttttggtctggctctgtttctttccagtcatgtcacctctccccatgacagagggtcagctggcttccagtgtttcagctaggcaggagtcggggattatggatagcatagaagagggaggaatatcaggaaggagctaacgttgctggtgtagggtcatttgagttcctgtatctctaggagaacaagcattgtctttggcataggacagaatgtggtcagaatcctctctgtcactcagaaagtaattccattgctgtcttaatattatcctagtcatctggggttgcaggaacactgtgtagtggttttgcggtgtggaagctattgctacataattttttatttcttgaatatcactttgtagtgtcatgattacaaggcttggaagaagataaactctctgtccattccgagtataaatgggcacttgagatgaaaccacctcgttaatttccccttgttgctgaagtagaatctgaatccaaaccacaacacaacctagcccctaaatctctattaaaaaccaccttgggtagtctggcaaagctttatttaaagtcagcagagaattataaagtcaaacgtgaaaaatggtacaacaagaaagaatcataaaaaaatactagatcagttaaatgtagtcaaaggcaatttagtgtgttctggcaccagcacttattgatgcaaagaatgtgatatgtcaggggttggcaagagcatgtaggaaatgcagaatgaaggatgcagctccacgcattgactccgaaacagccatacatggctgcagaggatgcttcagctaccttccttgcttttctatcaggaatttcagggagaatattcgaattcccctaggatggacattttctgttcttttgttcttgatatagtttatgttttaaagtagaattctttctttcatggagataagctaacatggagactgtgtaaattgggtcagaccaggagggtaagtaaaacttgctggtacttctgagtatcctactattctagtttctctggggctgctacatttatctgcttttttacatccatctccaagctgtgagggtttctgcctcatcttcttcacccctttggtttcccattcaccaatattagcagatttgctcagtaatgaacacagctaccaatgttatgcacccacccctttccaggcactgtgctaggccctgcatatacattctctcactaatcctcaacaagccccggtgattcttagaactctagtctgaaaaaaaaaaaaagcccctgtgagataggtcttatcagcatgttgattttacacataaggacaactagggctaagagacttagagctcatttgaggtgccacagaaacagaactcactaggccggactcctgtataggagcaggcgctatgtaagaagtgttggttctctaacttcatcaacagtaaaaggtgggtgccagtacctctaggggacagagtacaggatagtatagtgtcaagagcatcaggctgaagtctgggtttgaatcctggctttgccacttattgactctgtgactctggagaaggtacttgaccactctgcatctccctctccataaaatagggacaataataacacctgccttactaaggttgttgtgaggattatgtaagttgctatgaatagtttcaaatagttactgtggaagtgctgaatggtagtccccttacctctaggggatgcattcaagatcccagtggatgcctgaaaccatggagagtactgaaccctatgtatactgtattatttttttgtgtgtacatttataactgtggtaaagtttagtataattattaggcatggtaagagataacgataactgataataaaatagaacaattataagaatattccagcatcactacgcttgcactttggggccattattaagtaaaatagggttacttcaacacaaccactgccataccacaacagccaatccaatagctgagacagcttctaggtgactaagcggccgattctatatacagaatggacacactggacatagcgatgactcacatcctgggcaggatggaacaggatggtgtgagattttatcatgctactcagaatggcatgcaatttcaaacttatggattgttgatttctggaattttctattcaatattttcagactctagttgactgtgggtaactaaaaccatgcagaaagtggataaggagggactactgtatacatattgttgctgctgctgtttctattattattattatcaatagtgttgttatttttgtcttaaaaaatatatccctgaaagtagagtgccttcactgaaagaagtggttgtggatggaatcagggacaggggaggtggaaggaccagcccctgtggcaggtcagatgggaggatgttcttagacatgccactcggtacccttgaaatcctactttggtgtgggccatatccacttttggtaaactcatttgccccaaatgaagcagcttttgaagatcaaacaagaaaactggattctttgagtatatccagcttgagtacttccatgttcaaaatgcctttctttcctgtctacagattcacctctaggagagaaggaaagaagtttggagacttcctttggttctagcaggtcttatcagagtctcagtgtagactgaagaggagtgattgctatactgtaaatgctttagagggtctgaaagagattagagaaacctattccagaggataaaggcaggacaagagggagccattaatctcatggacattacattccctaagaactttttttgggaatggccagaagcatgccaggccatgtgctgtccatttgcaattctctgagctgtggagttgtgtgtgtgtgtgtgtgtgtgtgtgtgtgtgagatagattgaggccaatgtcattgcctcatttacaatggttcttaaacttgaactgaaaggttgacacatgcatgcagagtcaatgcagattattcgactgaagtagtcctgacaaataccagggctctccacattgtcaggaacagtctgatgatgacacgttcgaagctccgcagactggcttgcatcttagtaaatgtgtacaatcaggggagacatagctatgccgtggagagttctgagatgtgaagagaacaagttaattgttcagcctcaactgagacctttcactcaagtcattaatcacagtgcacagtctggagtcttggctctgaagttcgattctttaggctgctttcctgctccagatgaaagctcattccaggtgctggccatttgtgttttcctccaactaggctgatttatggacctggagatgttttctggtttttccaaattctgttccattactttgtaataaggggggacatgtgatttctggctttttgcagatcctcagttttaacatccctaataccaaagatttttaaaattagtctgtggtctgctttctgtgatctggagaatagaaatgctgttctgtattttgagtatcaaagttaagactttagggactcatttctttccccttgagctggagttgaagttgcaagggatgggcaggaaactgtgttcctgccttcaacatcccaatgcaaattaaggcttgggaagccctagtgacagcaactgactgcaggtgttggagatatccccgtcccacccgaatacatatggctcagggtataatattaaaggacttccacacttgggctaggtctctggtgacagtgtaagccaatattgaagatttcaaaggagaatctgagtgtcaaaggaggacattgtgatatggaggctgaacagggtgctgccaagtgttagctgtttgactgaaaggtaaaccagatctgagttgatatggggcaacagatcccttgggagttttcccaggaggatagaaatgtgtcacagcaaagtaattggaaattgatatttggcatatctctgggttactttttattccagataataccaagagtcacttggtattggccaagagtcattagtgacttatacatcaaatcccataacccattgctgaaatacaatcttctgttcgttgacagtagccagctgcttcctggtcctctgcttcctaactagtactttatgttaaaggcccatggccctgatttaggtgaaatgagtggtaaaaatagcaattcaatcttataaaaaacctgtctatacttttaaaaaattgatatataatcattgtacatatctatgcggtgcatgtggtattttgatacacgcatataatgtgtaattattaaaccagggtatttgtgatatttatcacctccaacatttatcatttctgcgtgttaggaacatttcaaatcttctagctgttttgagatataaaataaattatttttaactatagtcataattgtgctgtcgaacatgatgtcttctatctaactaaatgtttgtgcccgtaaccagcctctcttcatccccctgcactgcaccaattctaccttttgataattctctgaaacgaaattttcactggcagtgctgtccttcaaattcaactcaactcaacaggtacttgttcagagcctcctatgggctttatattgtgttgtgtgccctgggacctataaaataagtatcaaacatgacctttgcccttgaaaagcttatgagctcataggaaggatgatgtgtttatgaaacacattttacatggcaagataagctatcgtgtatgtgccaaagtgactagaatcgggaataagtgcaacagagagtcagaaaaatgagagtaggttgtactggaactgtcagagaagctcttatggatgaggtgggacaaagacacaaatatcctaaacccagaactctccgttaaagaaattgtaagaagcacagcatcaggttaccaagaaattatggagcccttttaagtgaaagtaatttgttcaatatgagaatggattaatttagttccataaatatttattgagtacatgcaatgtgccaacaactatacctgatgtgatcaaggaagaataatgagtacaaaggacacgtgtgtgttattctcagatgctaacttctctcacataggtatttaaagttattgctggtctgttgattccaaagtctgtgatttttatcatttaccattcaacctctcaaaaagactttgtcatccaagatatatttggttgaggggctgagtctaattttttgtgtggtggaaaaatggcatgtctaactgcataagttgtatgaagtgtaaagagttgcatgcatgccgattgtgaaagaaagggacgttgaattagcattgaatgtgggcccaaattattgggttagggagtatttggagtagcattagaaaagcctgaacctggcccacattcagggctataagtgaagcccaagttctctatagatcaagcttttcttggaacttgtattgttccccttgacagctgatttggaaacccaattagaagggcctcccatcattagaggtgaggcagtcttgcactgagctttgttatttgagaagtttaaaattggctacacccagatatattggataactcactaaaatctagaattgatctgtattcctccttgtaaaataaggaaagccattatgtgttcatttctttgaggacaggtataactggacaattgcaaagtgttttagaaagaaaacaatgtcaggatgatagtggtggtagtggtcatcgtcatggagatggtagttattattccaaatatccagataattttaaaataatataaccatagaacgctagtaaatgctagaaagaatctaagatatcaggcatggaggcacagaggtgtcaaagtttatttagcgaagcaataccagaagagaactagaaaatcctgcttcctagctggctgtcatttgcatacaacaatgagacccctgcttagtaacccctgtgtttctgccacccatgtgactgctttctgaagctaatttagttatcaaataaaaaatggaattttgagaaaaccgtatttttttttaaactggagggattggtggaaggaaaagcaagaagaaatttggaatcttggttcctgacattttccttaatgttcaattactctcttcattggaaagcttcgtcttggcctctatgggtgacacatccacttgtggtcactcactcctatgtatgcgtgtacatctgttgatatgcattcctcttcatcatctgtaggcattttacaaataatggcttgtgtgtgcgtgtgttttttatcatcttatgtttttaaatgaaaatgacaacttgaaaattctttgcagaaataattcttctatggtaaaggaatttcagcgtgtcttccagggtcatctttgggtcacataatttcatggaggagttggcagtgggtgggagggatataaacaatgactttggaatttttatctttccatcctgtggcaggtgggcaatgttggtaacaaagaaagttggttggtggagaactaggaaaatatagtcaaataagaaaggtacaacaagatgtgagtgcaaaccaaaaaattggcaagtgcaaaacaaaaaattggcaaggcatagaaagagagaagaggaggcatggatacttttcccctctcttccaaccctgctcctctgtgaagccattgctgaggtgggggtgcgatcaggagagtatataaaggagcttggactttgcagttgtaactcttgtttttgatgaaactgttttggaagctttcttcttgaatagagctgggggatctgagtgggactcagaagagaggagaaaggccatttggaactcgatccagattctgggtttaaagatgagaaagtattacagggtttccataaaccacggagttcaggttggcagcatggaaatctgatccagtttttactcaccaaactatgtgtgtggaggtacacatcagaggggtacctttttcatatttatccaaagcactgtgtagaagagactagtccctggatgggggaattttaaacttccttctaagttttccaatcctatctgcatatttttagagccggagtttctaagcaaggcactctatattgtttgttctcttgggtagttaagcacagacagcagggaagcatggtggctcacagagtgaactagctgcagagaccaacttatccaatgaacaaagtaggtgtaaaatgaaaatgactaaaggggtccttgatttcactctcttgagaagtcagccacaaagccaagtgcctagagacccacatttccagcttctctcgtctccagtctccctttaggaaggctgtgagcaaacctggccttcgtggttctttcttccgtctgtaaactccctgtaattattatgcagttccttatgctaggtaccatgggactgtgaggcctccggaagaaactcttgactttgaggagcttggaggccattgtgaaaacaggaaagacaagcacaatcctggtaaatgaagtgtgtacaaagcctgtttgacaacaaagtcctctctagaggaccttgaaaaatcagagaccgccatcccatatggagaggtccttccaccctcacctcaggggctgtttttctctcactgaagaatgaaaatggtaaatggcctcaagcaagctaaaagcagatccctcagctttattcatttcctgactgcaatacttggtggtagtattagaaaaggctctggcagtcctcgtaggagaaatgccagtaatgaggcaatggaacgttcattcacctgctttatgttcttttggaaataacatgatttataaaagaatacagaatcataattgtcagccaagatgtcattttaaccttaggatgtccagaaacaaagggatattacatcctttgttcttggagcaccactggtgtcaaattatgcacagcgtttcctcttggcattaagtgcttgtgagcctaacagcaaccaaacactgacttcagaaagatgatgtttctgatggttttctcacctgaatatctccttggtactatgggagagagcatgggcctcctagcttccctgcattctgatagagcaggagccaggaggcatggcagtcttagaaatggctaagggttggggtacactgtctttggcctctatcagaggagctgaacaagagtcccattaaaatgctggtgaaataattcataaccttgattttatctgcacatcaacatatgccaacagatgctcagtgcaaaacatgaatatttgattaatataaaatcaggcatctagagcagagagcgtggaatgttgggggttgagtaggacttacatgttatccatctaatcgcagctgtctggatgcacatagtaggcattggaaatatccataattatattttcattgatttgaataactctgttgcttggttttgagcccagatgtttggcgtcccgctggaactgtgtgctctgcctcctgtcatcagtctcatcagcacacagatgttcggcaagggacagcattcctctagtcttcattgtgaggcctcttctctgttctcccagcccatccactagggctcctgtgacagtcagccacagaacacagtgcaggtcacccatggagctaggtgcagaaactgtccaccacaccattttgtcattgtggttttatccaaaggcagagaacattggagcctcagctaacagaccagactaatgctggtaacaagtacttgagtggttatttcatcattcattccattggtcattgaaaaaatattgagtaaaggcttattagtccacagcacttccctgaaacctgaagaagacataggagaagacccttggtaggagatggagaaggttgcactgtgagtgagaatatgagacattcattaacttctagggaatgataagactggttacattagtgctgatgacattcacagcagaggggaggggaagctagttggtagagtggatagatagtacactagatccaagtctgtatcttgaatctctctcataacaccagcgtgtggctgtaaacccaggcctccggtttcctctgtaaaataaaggagatgcactaagatgctttctatgcctttcagtactatccttcagtttgctctgatcaagaattgaagagatccccatattcccgtggtttaattttccctgaagaccttggactgaccactttcgtaagtaatcaggtagacttctaatagtcaaaggacacatgaatgaaaggtagtgaaagaaggcatacactgatgccttaatatcttggttagaatagcggcttttgaaagtctatgaaaatcaattttggataataatagaaaaattcgttaaggctgggagtagagctttgcttcaaagtgaaatagcagcaagttttacctttgctcatgtaccatcattcttgaattagttattaatctcaggaccaagagcaacttgttgcccttggatcggtccagtggcatttctttttcttttgtttttttttatttttttgagacgcagtttcgctcttgttgcccaggctggagtgcaatcacacgatcttggctcatcgcaacctcccgggttcaagtgattctcctgcctcagcctcctgagtagctgggattacaggcatgtgctaccatgcctagctaattttgtatttttaggagagacggggtttctccatgttggtcaggctggtcttgaactcctgacctcaggtggtctgcctgcctcggcctcccaaagtgctgggattacaggtgtgagccaccatgcccagccctagtggcatttctgacttccttggttcacatggtcttggtatgacagccctatgaatgggtacctgaggagctctgctgccagtgttcaaggtggcttctctttagctcatctaagatacaggggctatatctttaaaaagtagagacaggatgattaatctgtagttggacagattaattgtggcttccaatctcttcagaccctgtgtaggcagatcaagtaacttacctacataaaaggcaaagcacagaagtcatgaacattctcacttctgtgtagtactatatagcttcctgaaaggtttataacaatttctaaccaacttgtttaatccccacagttctgtgaagtcagtattatattcttacattgtaagtgaggatattgaggtacaaatgtatttgtggggttggaaatttctcacaggacatatttggtggatgctgggaagagctactctcctgaaactccaaaaccccctccctccctcacctgctacagttgaactttttctgtaagttaagacatttctgattctgggtactcttttaaaatgcagatacccctggaagagaggtcagaccaaatttcttattgcttaaataattgcctgaataatgttttacaatcattttcatctaagatagttgaggacagcatgctaacatattaaaatcaggattaaatgggctgggtgtggtggcttatgcctgtaatctgagcactttgggaggctgaggcaggtggatcgctggacgtcaggagttcaagaccagcctgggcaacaaggtgaaaccccgtctctactgaaaatataaaaattagttggatgctgtgttgtgtgcctgtagtcccagctactcaggaggctgaggcaggagagctgcttgagcctgggaggcggtggttgcagtgagtcgagattgcaccattgcactccagcctggatgacagagcgagactgtctcaaaaaaaaaaaagaaaagaaaaatcaggattaaatgaagggggaccaggatagatttgggtttggggagcttgtttaggagtagctatctgataggggtataacaatggtgaccccaggactccagttctgaatgaaggaagtccccatctaagggatagtatgggacacggagcaagaagataatggaaacagagcaactctttatatttcagacttggttggcttatttgtgctggatcgacccctggtgagtgggcaggattgtgatggatggggtcaagcttatctaccattacatgccaagtacctggcttagggcattgatccattttatatactctcttattttgctaactacttaaggcagaaaaatcattcccctattctactccaatatgtgccagttgaaagtgaaatcctcacactgagcaaatgcaccaaagaacactatataaacttaatgagggagatgaagagatatgtgccagaaacctagaaaatttaacactgatgaggttatgactattatatgtttagttaaattgttgacactgacaggacgtggctgaggaaatctaccatccattttctccttgtaccagtgataatggttccttggtgtgctcttctcagttaacaaaaatattcccaaaagttaaatgcagggagaagaagtgacataagaagtacttttattatctctgttcttctgggagttccctccagaaacattatttaaagcagtacttctcccgactggcaaatgagtttgaagggaaggactcacgagttcagaggggaccggagaggctcctaaccctgtgcttgaaggcttgctccagcaaacccacataacacgacactgccatagcctctcaaaaacacctttctcttccattttcttcctttcaaaaactgacaaaggttatccacgggctagtgaataaaatctcaattcctttagctgacattcaaggcacaaatgtgatcgtgatttttgtaaggtgtcaagtgctgtataaacaggtggtggagagagtattgaatttgaagtcagaacactttggtttcaatcttgttaactgggtgaccttgggccagtcacttgatcactctgaatctcagttccttcacttataaaataggattatttcaatagttaaattaattgaaagtaacatagtacttagcaaagagtgaacattcaatacccattaaggaagagatggttaccagaggcaatttattctagcatttaagaacattcactatggagacaaaaattagtaatcttttttatttatttatttttgttttagattcagggggtacatgtgcttgtttgtacccccctggtggggttgggcttcaaatgtacctatcatccaaatattgaacattgcacccaaaggttaatttttcaacccttaccctccttccaccctcccgccttttagagcaatctttcttttgtctttgatttctacctagaaaatgggggtaagttggaagacttagatgagttaatacatatcaggaactttcaatagtgcttggcctatattgatccttctataagtattaagtcttttcttgctactgttgttgcttttattgaatgacctgtcctaatcttatttttcctgacttatctgattttctattttaccagcagacagagctcctccacaaagtcatgatatcattagggtggggattaattcctacctttaacttccatgagctttactcaatgcctgcaaaatactcaatcatttttgttattaaaaagtgtacaaatgtgcttgctaacatcgacctagcattgtgctagaggtttcagcctgtggagtaaggaaagaaagaaagaaagaaagaaagaaagaaagaaagaaagaaagaaagaaagaaagaaaggagggagggagggagggagggagggagggagggaaggaagagaaagaaagaaagaaagaaagaaagaaagaaagaaagaaggaaggaaggaaggaaggaaaggaaggaaggaaggaaggaagggaggaagggaggaaggaaaaagaaaagaaaagaaaagaaaaaagaagcatccagattggaaaggaagaagtaaaactgtctttatttgcagatgaaattatcatctctatagaaaattcagtggaatgtacataaagctgttagaagcaacaggagaatttagcaagttacgggatgcaagattaatatgcaagtcaattgttttagttccttaaacttaagacagccacaagtagaccagtttaactggagcataggatgagtgaggggtagtgtggtatgtaaaattagaaaggcagatctagataacatggaatacttttgcttactctttctctgccttccttcattccttttcccctcccccacctcctttctttctttttcctttctagtttcttggtataacaacctttttccataaaagaagggtagaacttctttcttaaaggcgaagttatttattctttgggttaagtcaaacaaaatgaccgtaactacgttgttttgagcttacagttaatgttctgttatatataaaatgttcccaaagacaaggagtgaaatgtcagcaagcaatcactggaacatagggtatcaggattcaagttctgatttcctcttaactagctctaataactttgggaagatcacttcaccttttaaggcccagtttgctttgtcttaaaaaagggataatgattgcatgatttccatatttatagggttgttgatggcttactccaacaaaatttttctagttcttagaaactctaagagctggagatagggaatcactcccctcagggaatatttagtgaaaatatgtgtagaactaactccagtggcataggataggctattcagagtagtatacataagggcctaggagagtgcaaagaagggattaattaactctgcttgtggggttgggaaaaatttcgctgagttgatatctaaagccaagctcacagcttaagtgagatttttgacagagaaagggacaactttaacatgataatgggaataatatcttttgtttgtttagcactttaccattttacttgacataaattagagtgatctaaaaactatatggacgttagggattattattgctatcctaggggtggttattactttaaactacttgtttgataaggctggggaaattttgaccccaaattgtaacaatttagaaaagtttatgtaaaatttccagggaatttttccatgttgggggaaccaggagccttaggagcttggtggggtgtcaaggattaggggaggggcatgggaagagggaaaaaggatattaattaaatctttgcaaaaagatggctcattttgtaattatggcataacttgctgagtaaagatgcaataatatgaaaacctggatgtttaacttttttccccataagttattggggtacaggtggtatttggtacatgagtaagtcctttagtggtgatttgtgagattttggtgcacccatcacccatgtatacactgcaccacatttgtagtcttttatccctcaccctcctcccatccttccccccaagtccccaaagtccattgtattattcttatacctttgcatcttcatagcttagctcccgtatatcagtgagaacatacaatgtttggttttccattcctgagttacatcacttagaataatagtctccaatctcatccaggtcactgcaaatgctgttaattcattcctttttatggctgcatagtattccatcgtatatatatacacacacacacacatatatatatatatatatatatacacacacacacatacacaccacagtttctttatccactcattgactggtggacttttgggttggttccacaattttgaaattgtgaattgtgctcctgtaaacatgcatgtgcatgtcttcaaataatgacttcttttcctgtggctagatacccagtagtggggttgctggatcaaatggtagttctacttttagttctttaaggaatctccacactgtttttcatagtggctgtactagtttacatttccacccgcagtgtagaagtgttccctgttcactgcatccattccaacatctactgttttttgatttttttattatggccattcttgcaaaagtaaggtggtattgcattgtggttttgatttgcatctccctaatcattagtaatgttgagcatttgttcatatgtttgttggccatttgtatatcttcttttgagacttgtctatttatgtccttagcccactttttgcttggattgtttttttcttactgatttgtttgagttcgttgtagattctggatattagtcctttgtcagatgtatagattgtgaagattttctcccgctctgcgggttgtctgtttactctgctgactgttccttttgctgtgcaaaagctctttagtttagttaggtctcagctatttatctttgtttttattgcatttgcttttgggttcttggtcataaaatccttgcctaagtcaatgtctagaagggtttttccaatgttatcttctagaatttttatagtttcaggtcttaggtttaagtccttaatccatcttgagttgatttttgtataaggtaagagatgaggatacagttctcctacatgtggctagccagttatcccagcaccatttgttgaaaagggtgtcctttccccactttatgtttttgtttactttgttgaagatcagttggctgtaagtatttgggtttatttctgggctctctattctgttccattggtctgagtgcctatttttataccagtaccacgctgttttgatgactatggccttatactatagtttgaaaacaggtagtgtgatgcccccagatttgttcttttgacttagacttgctttggctatgcagactcttttttggttccataagcattttagaattgttttttctaattctgtgaagaatgatggtggtattctgatggggattgtgttgaatttgtagatttcttttggcagtatggtcattttcacaatattgattctacccatccatgagcatgggatgtgtttccatttgtttgtgtctatgtttagaaatctgtgatttctttcagcagtgttttgtagttttccttgtagaggtctttcaactcctttgttaggtgtattcctaagtattttatttttattgcagctattgtaaaagaggttgagttcttgatttgattcttggcttgcttgctgttggtgtatagaagagctattgatttatgtacattaatcttgtatccagaaactttgctgaattattttatcagttctacaagttttctggaggagtccttagggttttcaaggtaaatgattgtatcgtcagcaaacagtgacagtttgacttcctctttaccgatttggatgccctttatttctttctcttgtctgattgctctggctaggacttccagtactatgttgaagaggagcagtgagaatgggcatccttgtcttgttccagttctcagagggaatgctttcaacttttccttattcagtattatgttggctgtcagtttgtcatagatggcttttattacattaaggtatgtctcttgtgtgcccattttgctaagagttttaatcataaagcgatgctgggttttgttgagtgctttttctgcatctgttaagatgatcatgtgatttttgtttttaattctgtttatgtggggtatcacatttattgacttgcgtatgttaaaccatccctgcatccctggtatgaaatctacttgatcatagtggattttcttcttggtatgttgttggatttcgctagctagtattttgttaactattttagcatctatgttcatcaaggatatcaatctgtagttttcttttttggctatgtgctttcctggttttggtattagggtgatgctggattcatagaatgaatttgagagggttccttctttctctatcttgtggaatagtgtcaaaaggattggtactaactcttatttgaatgtctggtagaattctgttgtgaacctgtctggtcctggactttttgttgttgttgttgttgttttaatttttttaatttttaatttttttttttgaggtggagttttgctcttgttgccctggctggagtgcaatggcatgatctcagctcaccgtaacctctgcctcccaggttcaagtgactctcctgcctcagcctcgcaagtagctgggattacaggcatgtgccaccatgcccggctaattttgtatttttattagagatggggtttctccatgttcatcaggctggtcttgaactccagacctcaggtgatccacctgccccgatcttaggtgatccacctgcctcggcctcccaaagtgctgggattacaggtgtgagccaccgcgcctggctggtaatttttaaatgaccatttcaatcttgctgcttgttatttgtctgttcagggtatctaattcttcctgatttaagctaagagtgttgtatttttccaggaatttatccatctcttgtaggttttcctttatgtacataaaggtgttcatagtagccttgaatgatcttttgtatttcagtggtctcagttgtaatatctcctttttcatttcttagtgaggttatttggatcttctgtcttcttttcttggttaatcttgttaatggtctatcaattttatttttcttctcaaagaacctgccttttgtttcatttatcttttgtattatttttgtttcaatttcatttacttctgctgcgatcttggttatttcttttcttctgctggatttggatttggtttgttcttgtttctctagttttttgaggtgttactgtaaattgttcttctgtgctctttcagactttttgatgtaggcgtttagggctgtgaactttccttttagcactgcctttgctgtatcccagaggtttcaataggttgtgtcactattgtcattcagtttgaagcatttttttaatttccattttgatttcgtttttgacccaatgttcattcaggagcaggttatttaatttccatgtatttgcatggttttgaagattccttttggatttgatttccagttttattccactgtggtctgagagagtacttgatataatttcaattttcttaaatgtattgaggctcgttttatggtctgtcatatggtctatcttggagaaagttccatgcattgttgaatagaatgcgtattgtgtggttgttgggtgaaatgttttgtatatatttgttgagtccatttgttccaaggtatagtttaaattcattgtttctttgttgactttctgtcttgatgacctgtctagtgctgtcagtggagtattgaagtctcccactattattgtgttgctgtctatctcatttcttaggtctattagtaattgttttataaatttgggagctccagtgttaggtgcatgtatgtttaggattgtgatattttcctgttggacaaggtctttaccattatatactgttcctctttgtctcttttaatgctgttgctttatagtttgttttgtctgatataagaatagctacccctacttgtttttggtgtccgtttgcatgaaatgcctttttccactccttcactttaagtttatgtgagttcttatgtgttgggtgagtctcctgaaggcagcagatagttggttgctgggttcttatccattctgctgttctgtatcttttaagtggagcatttaggccatttacattcaatgttagtattgaaatgtgaggtgctgttgcttttatcatgctctttgttgcccatgtacttggttttttgtttttgctttttaacttgtatttttgttttataggtcctgtgtgatttatgctttaaagaagttctgttttgatgtgcttccaggatttggttcaagattttgagctccttttatcagttcttgttgtggtagtttggtaatggtgagttctctcagcatttgtttgaaaacaactgtatctttccttcatatatgatgcttagtttcactagatacaaaattcttgcctgataattgttttgtttgaggagcctgaagataggtccccaatcccttctagcttgtagggtttctgctgagaaatctgctgttaatctgataggttttcctttataggttacctggtgcttctgtctcatagctcttaagattctttccttcatcttaaatttggataacctgatgacaatgttcttaggcagagatctttttgtgattaatttcccaggtgttcttttgcttcttgtatttggctgtctaggtctcttgcaaggccgggagagtttgctttgattattcccctaaatctgttttccagggaaaacctggacatttaaatgctagtttaacatggagcagaggactccatttttgtaaaatgctgcaacctgggaatttcctttcataattttgatagacatatggcacttctggttgagaactgggcctatagcagtggcttaacttaagggttccatagatccttgccttggttcaacatatcccatctacgagatgacaaatgtttgattgaagaagtattgaagagtatttggaaatgtagacaaataacagtatctggagcttgcagcacagtgggaaatggagccaagactgtacctataatttagggtaaggagcaataatgaggtcccataaaaataaaaaaccatgatgttaaatagactgcagatcatttgcaccttgaggcttttcttagattttatgccagcaaaaaaagtagtaatagggcttgtgctttatgccaaaagaattcctcgtacacaagattttatttgctttagtgtaatcaaagagaccctccccctaaaattatataagggtaaaaaaaaacaaaacaaacaaacaaaaaacccatccagctataaagagctgccagcctgggtttggagcatggctttaatcctctgtgcctggggtcatattgtttttatcttgcttttgactctatttcaaagctgatgttgctatctacaaaccttacctaacagctataattatttcatttgtattcactatgaagtcctttccaatcatgttagagaaatggattccagtgtttgcaagtgaccccttatcctgtcttttaaagaaaatagcatatattgtaggctccccttatctgcatttttgctttccacagtttcagttacccacgatcaactgcagtccaaaaataagatattttgtgagagagagaaagactatattcgtataacttttattatagtatattgttatcattgttctattttattattattattgtaaatctcttaccgtgcctaatttataaattaaacttaacataggtctgaatgtataggaaaaacatagtatacatactatatatagtaagtggagagcacaccaaatgtatatcatttttgtactgtagtaaatttgaaaaattgtaggtcaacccattataagttgaggatggaaggtctgtctatagggttcagtattacatgtggtttcaggcatccattagtggtcctgatgtgtcctctacagacaaagggggactactgtaagtttgtaaaaccactgaacaaggagtttcaaatgtgataaaatattaaaatgggactcttcaagttcagctgaagccacaattaataggaatcaactggtcgcacattccaagatgagatgctagatcaccccagcaggacctgcaagagttctaaaatttggatcgtgtcattgcctgagctttcagacattagataagtcaagtcagatttgatccttagttttttcctttgtcaagtgggaacagttattgctacccagtgaccttgtagggatgtgtcaattgagatgctggacctgaagatgccatgaaaattcgaggtagtggttctctttctccttcttgcagtggggttttgggtcacaaaatgacaggattgtcctcagatactttatagaaagccattggtgctgttaacacagtatgagtttagtgtttcattttggagtcaaacacactttatttttttttctcacaactgcttctgtgaatctacttgcagggctagatcttctgccctggaatcatatcctagctagtgctcagagcctgccactcactctttggtagtaataactcctctcattggttacctgagtttccaaacagtgttggttatgctataaataagtatagtctagggtaataatcaaaactctgaaattcatccatgggtaatgcatcttctggcaccatcaagagcttgctacagggggagaagtgggctgagtaacttctttctcctttattcttccatatgctaggtgagttggataggggaagagaagagaagtaggagccaggatcaaatttgcttggctggtcccaacctggtattgatttgcttttctactggcagatgcttaagactggcctttcttctctgaaagctgtttcatgatttggacgcttatcactagggtcctcttttttgtgggtgattctcttttgatgataaatgaatcatctagggacttctctctgctgaggtctccttgcctctaacaaggcaaggtccaagactagctcagggtgctttgtcttgtacttggcacttacctcctccctggaaatatggatctttgacctaaaagtgttgtatagttatgtccccaaattgaatctgttttgtttagccacctagtgagcagctttagccatagtctttctttcactcattaactttcttagacttatgtaagatgggtatcagttcactgtgacccttaaaatgcaggggcacctaccaagccatctgagtacactaccaaagtccctctcatttgctagaaataaagggagtaccatagccctgatacttttccactggagggaagcattgcaagtacacttgaaaattctctttgaagaaatccttgccgggcacagtggctcacacctgtaatcccagcactttgggaggctgagcggggcagatcatctgagatcaggagtttgagaccagcttggccaacatggtgaaaccccatctctactaaaaatacaaaaattagccaggcatggtggcaggtgcctgaaataccagctacttgggaggctgaggcaggagaatcacttgaaccgaggaggcagaggaatgcagtgagccgagatcacatcattgcactccagcctgggtgacagagacagacttcatctcaaaaataaaataaaataaaaaataaaataaaataaaaagaaatccttaattcccaattctaagctcctctgatagtatattcagcatcttttttatgctatgcagagatgtactcagctaaggggtgcagacctgggtcttagacatctcctttgcaggtcctgctggggtgatacagtacctcatcttgcaatatgggaccagttgattcctattattttgtggcttcagctgaacttgaagggtcccattttaacattgtgttatatttatatcagcttaccccaaactgtagtctatggaacactgcttcagaaaagggttccattttttttaaaaagggtccttatcaagtgtatttgggaaatatatgtaagatttccagctcttcaggtgctcattgcatataagcctatcgaagaccatgtggaatctagcatgaggagtggtgtttgaccctttccaaacccagtgtttctcaaatatatttaaccacacaatttattaacatggtgtctctttgtttgcattttgggagatgctgctgtagatggttgctggtgatgcttccattgggtttagctaagaatgtccatacattcttccaaagttttcctaaataaaaaagcttaattccttcttagtagaaatgggctcattttaagatgagtatctgttttggaaatagtccatcagcattggcgatgtgaggaaaaaaagagtaatgagtaggcttgttgccttgcttattgcaaacagcaaaaaataaaagataagattataataatatttatatgtatcatagtaatattgattattatgatacaactcattataataggagtttgtagtatcctggtattctgtctggactttgagagcttagcttcaatgaactataaagggaaagtcatagttaattattctcacctggacaagatattgttatctcctgtgttttttaagtcactaccatcagttgcattggttttgagtcttcccaaatgtgtctacctttgggaaggcccaattggccagttcctagacagtttttttttatgtacacagctcattttcacatatggatcataacttcccaggctatcctagcatagcctatcccatctatcccctcattgtgtttcaatgataagatgatgggctttatagttcttttctgtttcaaactttgcaagtatttattctgaataacattagagtctcactagcatgaaaaactgtcctggtttgcctgggactgtcctggctttagtactcagagtcccacattctggaatcctctctccaaaatgcaaaatgtcttggttttcaatagtggatggcaaagcttggaaaaatacaaagcccatatgtcagcccaaaatataggtgctgaaagcaatgctgttttagtgtcaaataggtacagcatagattatctatcttccatagttattgttactattcacccctcccatgttgacaatcatgatttgcagttcacactaacggatcattcattattgtttcactccaattgatgaaactcaagtgtacaccataactacattgtaagttgagtgttaaaagtccatctgtctttgactttgtctttatattaacttgttgtgctttgtatcaagataatgccagtttaatttttaactttatgaatattgtgaccatattctctaagagttcagatagtgaaaatgaagatgattattataccaatgccagcatcctagaaaaagaaggttagatggttgctattttaatggcagatgaaaggactcatacgtctggattgggcagataaataatcaaaacagagcatactgcacaagatgcagaaaagaagatataaaagtgcatagggagactgaatcccacaattttggcatgaggtagacaagtacttctgagtcaatcaaaagtttcttgtctcccaagaagacaccaacgctcagttgaatatagcagccactgaattatcttgagtatacgacacaaataagcagcgtcattgcattattcccttgattgctttctgaaactgattaaaattatatttcctgattcacaggttgcagttaaagtgccctaggcatgaacagcaggggaagttttgggtaacatgtgctggccctctatgtagcagagttaattctgttagatttgaacaacaactctagtatatcaagaaattcttgaatcatggcaataagataatgttccctttagctctttagtacttgaacttgataaatggagattcagaatgtcttttggatttttataaagattttaatgaaactgtagaaacataaaacaaaagattactgataacttgtctaaaaacaagctagatttagctcatctatctgcatgtgtggcaggcagtgcaaatgtaaattttggtaaacttcattcagtgtgtaaatttcttaacaaagaaaagaaaaagatttcaactgctaaaagttcagtatactttttctgcaaggatgctaaaaaaaatgggatttgcttacctgtgatattgaggctttttctaaaactctctgatgatctttgaagaagccataaggagcctagaaaaggacaactgactatacccaagttgttggatgttatgtgtaggatgtgacagaaactcatacagaaaaaaaggacttatgttttggaaataagcctgtttcaaatgaaaaaaaaaaatatgttaccagaggactgccaggttaggccaatctttctcagtttttcaatttctttaataaaactgtcacttacttggaatctggctttgatttcacaagtttgaattacttctgtgctttaaaaccattttacctgccaaagaaaagttttgcttatgatgacatccaaaatgcttcgtagtgttttaaaaatgatcaacatattggacatggataacctatatgactagtttatagatgcagtggatctgactgacaaactgctggtccatcaaagcaggcatgtggatacaaagtggatgaacatttttggagagctagaaattaatccctacaagtcttaaatcctgatgttactagtaagtaaacttctaagtgttccatgctgaattttttttttttttttcggggggagaggatatttgacttggtggagtcataccaatacagtgtaaagtgggcttgataaagagcatagtctaaagttaaatcaagttttacatttgactatattcatttagttttaacactacagaaaagaatagaagtgtgttgtaatggttgaaagcagtttaaagaactattactggaaaaggaaacagagagtaagaatatcctgctgtatcatgctgtatcacaggacagatggaaacgtgtcatagtttttgggttttttttaatagacatgagggtacaagtacattattattacatggttttattgaatagtgatgaagagtgggcttttagtgtaaccaacacccaaatagtgtatatcattcccaataggtaatttctcatcccttacccctcagccacccctccaccttttggagcctccagtgtctattattccattttgtatatctatgcgtatacattatttagctcccacttatgagtgaaaacatgcagcatttgacattctgagttatttaactttagataatggcatctagtttcacccgtgttgctgcagaaaacataatttcattcattttagggctaagtagtattccataatatatacatatatatcatgcctctctatctacctatctatacatacatacaaacatacacacacactactatagatacacacacacagcacattttctttatccagtcatctgtggatggacacctagattgattttataactttactattgtgaatagtactgtgataaacatacaagtgcaggcaactttttaatataattttttttcctttgggtagatatgcaggagtggaattgctggatttaatggtagttctatttttaattctttaagaaatagccatactattttccataaaggttgtactttcattcccaccagtagggtataagcattcacattcctgtttctccacattcttgccaacatctgttgtattttgactttttaataatagccattctgactggtatatgatggcatctcattgtggttttaatttacatttctctgatggttagtaatgttgagcattttttcaaatgtttgttgggcacttggaagtcttttttttttttttttttttttttttttttttttttttgagacgtagtctcgctctgttgcccaggctggagtgcaatggcgcgatctccgctcactggaagctccaccacctgggttcacaccattctcctgcctcagcctcctgagtagctgggactacaagtgcctgccaccacacctggctaattttttgtatgtttagtagagacagggtttcaccgtgttagccaatatggtctcaatctcctgacctcatgatctgcccacctcggcctcccaaagtgctgggattacaggtgtgagccaccacacccagccgtatgtcttcttttgagaatgtctgttcatatcctttgcctaccttttaatggggttatttattttgtttttcttgttgagttgtttgagttccttgcagattctggatattagccctttgttggatgcatagtttacagatattttcctccattctgtagattatctgtttactttgttgattatttctttgctatgcagaagctttttaattaaatcccattagtctgtttttgtttttgttgcatttgatttggggctcttagttacaaattctttgcctaggccaatgtcagaagagtttttgctaagttttcttctagggttttaatagtttgaggtctttattccatcttgagttaatttttgtatctggtgagacatatgggtccagtttcattctttcgcatatggctacccaattttcccagcaccatttattaaatatgatgtcctttctccagtatatgttttgtcaactttgttggagatcagttgcttgtagatatgtggcactatgtctgggttttctgttctgttgcattgattgatgtgtctatttttataccaatatcagactgttttggtttcaattgttttgtagtataatttgaagtcaggtaatgtgatgcctccagcttttttctttttgcttaggattgctttagctattcagtttcttttttggttccatctgaattttaggattattttctctatttctggggaaaataatattggtgattcggattcgataggaattgcattgaatctgaatattcctttgggtagtttggtcattttaacaatatttgactttttaatccatgggcatgggatgttttttctatttgtttgtgtcatctgtgatttttttcatcagtgttttgtagttctttttgttagagatcttttaccttcttggttaaatgtatttctaggtattttacttttttatagctattgtaaatgggattgacttttgtattttgttctgagtttgattatttttggtgtatagaaatgctactgatttttgtaggttgaatttttattctgaactttactgaagtcagttatcaaatctaggagtcttttggaggagtcgttaaagttttctaggtatcagatcatatcatcagaaaacagagataatttgacttcctctttcccaatttggatgccttttatttatttcttttgcctgattactctagctaggacttccagtactagaataggagtggtgaaagtggcatccttgtttagtcccagttcttagggggaatgctttcaatttctcctcattcagtatgatgatggctgtaagtttgttgtatatgtcttttattattttgaggtatgttccttctatttctagtttgttgagggttttaatcatgaagagatgctgaattttattgactgttttttttctacgtctattgagataatcatatggcttttgtttttatttgtgcttatgtggtgaatcacatttattgatttgcatatgttgcaaatccctggaataaaacccacttgattatgatatattatgtttttgatgtgctacttaattcaatttgctgctattttgttaaggatttttgcatctatgtacatcaggagtattggtgtgtcttttcttttctctctttttctttttttttcttttttttttttttttgagacgatgtcttgctctgtctcccacgctggagtgcagtggcgccattttggctcactgcaacctctgcttccccggttcaaacaattcttctgcctcagtctcccgggtagctggtattacaggcatgcgccaccacgctcagctactttttatatttttagtagagattgggtttcaccatgttggccaggctggtctcagactcctgacctcaggtgatccacccacctcggcctcccaaagtgctgagattacaggcgtgagccactgtgcctggccttctttgtgtgtgtgtgtgtgtgtgtgtgtgtgtgtgtgtgtgtgtccttgcctggctttggtatcagggtgatattggctttatagaatgagttagggaggagtccttcctcctcaattttttggaatactttcactacgattggtgccagttcctagaatgtgtggtagaattctgctgtgaatctgtctggtcgtgggcattttttgtgattgttaggagattttttactactgattcaatctcactacttgttattggtttattcagggtttctattttttcctggttcaattttgggggttatatatttatcgatttcctataggttttctaatttgtatgcatagaaatgcccatagtagtcttttatgagcttttgtatttctgtggtttcaattgtaatgtgttctttatcacttctgattgtgcttatttgacttttctctcttttttcttgtttagctagcagtttatcaattttgtttatcttttcaaaaaaacgactttttgttttatcgatactttgtgttgttttttgattttaattttatttcgttctgctctgatctttgttatgtattttcttctgctagctttgggtttggtttgttcttgtttttgtagtttcttgatgcgtgaccttagactgttaatttttgatctatcttttgaatataggcatttaatgccataaactttcctcttagcaccacgtttgctgtattctagaggttttggtttgttgtgtcactgttttcatttgtttcaaaaaattttttaattcttgccttaattttgtcattgatccaaagatcattcagaagcaagttgtttcatttccacatacttgtataattttgagagtttctcttggtatcgacttatagttttattctactgtggtccaataaaatacttggtatgaatttgagtttttaaaacttattgagacttgttttatggcctaaaatgtctattttggagaatattccatgcgtagatgagaagaatgtatattctgtggttgttgggtagaatgttctgtaaatatctgttaggttgatttgatctagagttcaatttaagttcaaagtttctttgttgattttctgcctccatgtcattgttatttttcattatttataggtaatatctgtttctaatgttattttcattttctttttaaaaagtcttatgtttgtgtatcttaagaatatacataatataggccaggcatgatggctcacacctgtaatcccagcactttgggaggccgaggcaggcggatcacaaggtcaggagatcgagaccatcctggctaacatggtgaaaccccatctctactaaaaatacaaaaaattagtcgggcgtggtggcgggcgcctgtagtctcagctactcaggttgctgaggcaggagaatggtgtaaacccaggaggtggagcttgcagtgagccgagattgcaccactgcactccagcctgggcgacagagcaagactccacttcataaaaaaaaaaaaaaaaaaaaagaggaatatacataatatagcctataaatttaaatatccaataaagtgcttaaaaagtgttaaaacaaattgctttatcagaggacagaaacattactgtaatatttttctcacacatattatttgtttagttagtcctactattaattaatgttaattgccactgttaacaacctatttttatttaaataataaaatgcatgtagctgaaaggtaaatactatagaataataaataatttcaaataaaaccttatttttaacatttttgtgttaaaatactaatgtatgtatgtattagtaattaattattgtaaatttttatctttgcttttttttttttttttttggcttggaatggctgtaccctaggttactctaatggtcaccagggtacttttcccaagcccgtaatgttttaagacaagcaagcaaatctaattctcattaattgcctcttacctggtataagtaacctctcacattggacactgactgtaaaaggagttactattacattatccttatcaattatctgtgacagtggagccagtaattctcaaaacatttgtacgtcatttaggactctttttaaagtaaattacatttactttaaaatgtaatttatttgatatttggtatcttcaattttttgttggtgctaattgaaaaaaggagaattgacaatagtccatatatatcaccaatacctgtacatatctggtaattggctggggactgaaacttcttttaaatccagtagttagaaaatgatgcttatattttcataattgtgccctgtatttaccatctcgcaataatccataagagttttctggtattccaagcccttgtggagtgtccctttcttatcactaactaccctctcctcacatggaagtagacatataccctcatatccggtaagcatctccgtgcttacaaaagaatatcccactcctttagctctttggctcctttcttattcctacctatacttcaaagccccttgaaaatgccctccactttacaaaactttcttcagaccatttttctaacctacactcctgtgtaccacatgccttactactcagctaccatcttgtattgtcctgtgaagtctcatctgttctcttcttggatggattgagaagtagagatcatggcttattcttcccttgtatccacccagaatactagaacaaggctaggcaggttgtaattgttcaaaaaagaccatcaattggtttttataaatgatgagtcctgcaacacatgacatggaagtaggcaaataataatatatcttctcatagaaacgttgtccatcatgtttaacagcacgtgaaagcacattgttgcaatggaaaaataagtgaagacaggaaaaaatgaccatagtaaccctgactcctgggctaagattttagttaataccgtactacttctgggtagagactctagattatttaaaacacatagacacactcacatgcacacattcttacgcacatgtacacacacaagcacacaaagaatgggggtttggccttgacatacttttagaatttgataccagtactttttaacagcatggtctaaagttggaaaaataggaattcagtgtctagttgagttatgagttgagaatgaatttcacaacaaacctcgatgattttccaccaacaacaccaacccaaagacaatcacttggtggccatcgtattgcaaaagaagcagagcacagacatgctgtctgtttcacttaaatttatgagaacctgctgaaagggaatgtagaaagtaaacgacccatggtaaagcattgtgaatgaagggagaggtgctgtggttagctgggttgctcaattcctcagattctcaaagccaggagaaaatttatcctcttccactgagacataaactaaactccttttggccattaatctgcaaagttgatgcctgccatggtaattcatcagacatttttgtggggtgagtctggtggggcctctggggcatctgcctttgaaattcaaagaacagctttgtcccctggggacagagtgactttcttccctcattgcacatctggaaggggagtttctgctcccactctcccccaagccaaggcagggcctgaaagagctgccatcttcatgaagcatgtacttgtacctcacttttctgatcactctacccagactgtcagacgaagagaaggaagagaaatacagccagcacactgtttgtaagtgcctttttcccattacagttcagcacagagaaaggacaattactgtttttagtgggttttataggagccacagtcactgcactaaccattgtgaaaaatgagcagaattctcaagctacatgtctcaatcatctgcacataaattgggcaatggttttggaatcttggggtctaatctgaatttacaagtgtgtctccaggcccagtgacaaatacatgatctgaagacagcgggcattactatgaagaacatagccttgggtgctgggctcatcttttgccccttcagtaacaggcacctgccaatgccttggtctcttagctggaggtttctcctgaaccttccagtccttaagtgaactggccgtgttttctctacaggctcctggtcctctgtcctccagctctgcaccacactccagacacagtggttacctttcagttttttgagtacaccaatgtcttttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcatgatccacccgactcggcctcccaaagtgctgggattacaggcgtgagccaccgcgcccggcccaccaatgtcttttctacatagaactatccaccctgactagaaggccctgccgtacaatctttgtgatattggcttcttttgacattgaggtttcagcttgaatgtcatctcctcagagaggtcttctgagaccactcagtttaaaggagccacaaccagctacccaccagtcactttccatcatttgtcagtgtgtcactttccttgtgacatttactgatacctgccatttttttttctctctctcttctctttctctctccagccctctttctctctctctccccctttccatcccacttctacctctatgaaatagtaaactcccaaagagcatggtccttaatctgtcctgttcactgtgctatgtccataggatgtgttcagtcattcttgctgaatgaatggtttccctgttctttgggtgtttgactgagggtagcatgacatttacagtaaagtttatgtcatttttcatattaaaaaacatgcttggatcaacatcttttaggtagaattcactcttatacatttatctattaaccaatgtattcatttattcattcaattgatatttgttatctactatatgccagataccttggcgagatgttacagatgtcagagaagtttcggccagggaaatgatataaagaaatggagagagacacatgtgaaaacaaaatttcatattttataccgaatgttatatccagacctgtctgtctaatatccaattttctttttctagctaaactgctatctttctgctccaactgtctgctctccagtaaggctctttcttcattaccccacaattggacctcatcttcacttatgttattactttattctagactgtcttctctctgctgttttctttgaggccagttcaggactttccgtcccaggaaggtttccacaactctgtgagctcccatttgtcccctgagctgttctctttagtacgtaaagtctagacccttcaaaaatttagagctttgtactgatgatgattttgcttggatttgtatttcttccacatgtgttaatattgaaaacccaactcaattctatcttctttgagaaagcagccatgttttataattcttctaggtctctgccaatatcacaggtagtatagggaacataatagcagtcaataaattcttactgattgattggtgtcgaaattgggttgtcagttccagacggcatgctgaatgagagcaggtctgggaaaagcctcttcagcattcagcctccctgtagatcaagtacaggcaaagcttatggcaaaaggtggtgaaaggcaaaattccaatagcaagagtattattaatctacttaaggcattaagtgttgtccagtattagattggaccggaaatcctggttttcaactctttcccatttgaatgcccaagaggctgtcagtgagtgagaggaaatacggaattggctttcagttgcccgaggagaggagcttaaattcctagatttatggctctactttacctgaaacttttattttgcttttacttttatgtaccaatcgagtgtactctatttctgttggtgcttcctaaacagtctaagggagctctaaaaataagtaccaaccaatttatacagtaatgttcatagcgttgtttacagaatgcctcatcacaggtcggtatcctgggagaccccaaaaggtatgatactttcagagaggggccttagtgaaggaggtatagtttgcagtatgaatggtctgtctgtgatctctgaactcaattattctggtttttcaaaatctagtagtagtaaaagaagcaggcagagtgtagtagtcttgtgtcccgaatctctttactaacatgccatcttgctgcttctgtttggcctgattttcctcatcatgctctacatttctggaagtcctttggtcttccttctgttgaagttttctagctccttcatatcccaccttatcctcatttcctggagtgaactctttcttctttgactctctatagcactcaggtgcttcttcattcatttgctgcttattaaaattgccatttaatgtgtatgcatcttgttttcttaagttgactttaacctattgtttggcaggaactttgtctcatacttcttaatatctccagagtgcccatagtaaatgctcaataaatatttgctgctaatgatatatcttagttgactcatcttgtttctggtaaattttactgtaacaagtagcaatataatgatataacttaaaagaggacaaagaaaatctagagggactttgaacacttgattagaactctaaaagggagaaattctttcagtgttggtcagtaatataaaaattattttgaatgattttatcaacttgacatatctggctattattacaagtgtttgtttatgtgttaatctctcctaaacttgacaaggatagggtcttcttaagcacaaagtctatatattttatatgtccttggctttatttggattaccaagtgagtagagagctgaaaaaatatttattaaatgcataaatgaatgaataaccttcaaatccaaagctagaaattctgttaaagaaaagatttagaccctctatctctcaaagttgcaagttactaatgctgctcacccattttcggttaatactaatagtctgtcttctacatggggaagtttgttggactaaaatgtgataatagggaccataagttgatgcctttgcattggctggtttgggaatagctgttgagaggatacaatgtagtttcttttcagttttatttgtcagccttgatcttggtggaggaacatgttcttaacacctacaagataacaggattgtttaaacattacaatatcacaccccatatttgagttttatgaaaaactgtgaatagggccaatgtcctaatttgtcaaaaatgttaaactaatattgcaattctataaaataaattattgacagattttataacataaaaatgtgtatttttatatatctgtagcattataagcaaaattaaggaaaataagctaggagataatattttaaaatataattaaatattttattcctttattataggaagagcttttacgagttctactgaacaacaacaaaaaatccagtagaaatgttggacaaaagatgtgattatacaaaactagaaatgcaagtaaacataaaaagctcaaacttacttaaaaacttaaaatgaaatattcgtaaataaaactattactgagggcctataaaattttgggttaaaatgaaatggtaatacttaataaatgttagggcacaatgatgctatctttcttacatctttctttttagaagtaacttatttcaatgtttctggaaagcaatttgataatttttatattactacaaaaatatggtagctaccctttggctcaacaattttttagaacacaaaaatgcagtcaaagatgtatataaaagactgaaagtaattcttcatagccttgtttatatgaaggaaaactgaaaacagcctaaatatttaacaataggtgaaatgattagaaatgtggtatattcagagcaggcatagtggctcatgcctataacccagcattttgggaggctgaggtgggcaaatctcttgagcccaggagtttgagaccagcccgggcaatatggcaaaaccctgtctctgcaaaaactataaaaattagctgggcatggtggtgcacgtgcgtgtaatcccagctacttggaaggctgaggcaggaggctagattgagaccaggaggtagaagctgcagcgaggtatgatcatgccgctgcactccagcctgggggacagaatgaaacactgtttcaaaaaaaaaaaaagtggtatattcagatgatcatatattatttaacccacaaaaataagtctttttaaacttaaatttaaattttttaagtgaaagcaagattattaagaaagtaaaggaataaagaatggttattccataggcagagcacaaaaataagttttaaaagagtaccatgagattgtgcttataataacaagtggggaaaagtactaaaagctacatagagcatctcaatttaatggacccacacaagactttgaagaagttcactgaaatatcagcagtggttctcattgcacaataaaacagactgtgagtgatttttttgactgggtcaaacatcattgtcctgtcatctttgtgtgactgagaggctaagtgtcagaacactgtagatatagttagtttgaaggaattcattcattctttgaacgaaaaatgtagtatgtattatgagtctggtaccatgctagatcctgtaacaaggagcttagaatgaaatgtgcgatacagctaggtcagtagatatctatgttctaagtattattgtattaagtgcttggataatatagtaatgaggatgataatgatgatgccatagagaccacttatgtagatcttctagtttctgttgctgtgtaacaagttataccaaaagtttagtaactaaaaccaccgttgtattcagctcatggtttctgtgggtcagggattcagaaagcataaggtaatagctttttctctacatcacaatgtcttcaccctcagctgggaagacatgaatgctagggctgacttgactggaaatgggaatgatctgaagactcatgttcatacattcatctgtttgggctaggaggacccacagatgaggatttctaactgaaatgcctacatactccttgtggcctggcttgcttgtggtttggcagcctcagggtagttggatttacatgaaagtgcaaggtttcatgcccatgcattctagtcagcaaagcagaagctgcatcagaagtttttctgacttattcttggaagtcacacgtacacactgattcaagggaaggggacacggataccaccttctggtgggaggatagtcatgttgaagatcaaatggaattggagatattgtatgtgacttcattatgtgctagacattattcatactgctttctagcaagtagttcatttaatcctcactacaattcatgaggtaagtagtattagcattgcctcctttaaacaagaatctgaagtcatggagctaagtagcttgcctaaggtcacataataagtggcaaagctggacttcaaactcaggcagtctggctccagtgtttatgctcttaatcagtggaggtgatcaggttactagggacatatgcagaagacctgcctaaccctgacacaggacagggagcagggagtagataaaggaaggctcccttgaagaagtgatacctaaactgagttatgaaggattaacagaccctagtttgagacttgaaggactaataaaatggacagtagttagctgggctgtgggtagatggttggaatgggaaaatgcctcatgaagggagaacggcatgtagaaagcccccaggcaagtgagtacggcatattcaggcaattgcaagttgctcctcagtgctagaattcagagctgtggtggcaagtttcgaatggtgaggctggagagattgacaggaataaaattagaagggcccaagcaatccaatgattgcttgatcaccatactgagagatcaccaggatggtgatgttactgaattgactcttctgttttcctcctagcaattagccatgtatttattagcatttgccttttttattgtagtaaaatatataaaacttaaaattcaccatttaaatcatttttaagtgtacagttcagtggcgttaagtaccttcacattgtggtaccacgatgaccaccatccatctccagaatcttttcatcctgcaaaactgaaactccatactcattaaacactaacttcccattcactcctcccctctagaatccaccattctactttctatatctgtgaacttcactactctaagtacctcatataaatgaaattaatattatgtggacttttgtgcttacttatttcgcttagcataatgtcctcaaaattcatccatgcagcagcatgtgtcaaaatttcctttcttttttaggctgaataatatccaattgtatctatatgccacattttgtttattcattcatcttgttgatggtcatttgggctgcttctgccttttatctattatgaatagctctgtacatggatgtacaaatgcttcttaagacctatagataaatctttgagaccttgtttccgattcttctgagtatatatacagatttaaaatggccagattatgtagtaattttatttttaatttcttaaagagttaccatactgttttccatagcagctgtaccattttacaatcctaccaacaatgcacatgattccaattattccacaggctcatcaacatttattattttctgatttttgcttgtttgctcgcttttaaaaatagctatcctaatggatataaggtggtatctcattgtggttttgatttgcctttccccatcttttcatgtgctcattagccatttgtatactttctttggggcaatgtctaagaattgactttttagaatgatccctctggggagaagtaaaagggtagaaggagggtcagaatggaggcagggagatcaggtaggaagttgcactaaactagccaagatgtgataaggcttccatgatgcaactaatgaaattgtatggggcagtggtggtggtagatagcattgaaagattgttttgcaaattaagcagaacaaaaaaaaaaaaaacaagaaaactcaatgttaagtggatgatggcaccatgactggtattcagtcagtatgtacctgtgtagccattctggctgaaatacttccatggcagctcccccaagagtgccccttcattgcccctcccatccaggtcttcaaaatccttaaactgcctgtatgcccccataattccctaaataataatgaatgctgggtacagtagggggtaggggaaccttggactctgctccagctcagtagccagggtccattcagatttgtcagcccccttcccctctgatttactcctggatagcagtaccatttcttgacacatgtactgatgtggaaaagatttttggaaggtatgaagggagttcaccaaaggtgataagttttatttggggcctgtttgtgtattcacgtggagagagttagcattcttggttctagagaaaaagatttaggaattttcaacatatgatagtcatagaacccaagaacttaccatccaatggaaatattttccctctgcagtgacaccattctttcataaaattattcacaatttagcaactatgaacaggaataaaacctctaaccaatattccaaagaggtcagctgtgcctaaaatgcatgttggcagaatgtagtcacattcccagattttaggaagccaggaatccaggaaggagtcttcctctttctgtatagcaacttaagcttatttgaaggtggttgttcactccctcctggagtgcccttagctgcagacaaagagagtgggattcgtgatgatcatttggcatcatgtccctgacagatagcctacaatgttaccagaagctgatgaggcttattttggttttgtttcgttttgtggaaaaccagaagggatctcagtgttgctgcctgcaggataagtaaagataacctactatgtattttattggcaatcctgatagcattttctccattggtggtttatgtgtaatagagaccaaactgcaattttctgacctgccaagatccattatgtctggtaaatatagtttatgcttgacagaatacacacttagggtggaaagccatgcaaattaaactaaggtttaggctaatttttggtagtgaaaattattctcccttggtgaccttattcagcatgaaataaaacaaccagaaagctattcatgcagtccactctttctttaatcaaaataatgaaagctttggatagcccagctcctgattctcatagctcttgtctttcatggagcctaatcttttatggtcataagaagcttttttgcatgaataggttagagattaggtagtaaaatgccttatttaaggtaactgttcttagtctactttgaagtctatgcaaattatatctgtctatggatttatggagactgtatcaccacagagtcttgatctgttaacataaatgatattttaaaaatatttacccattgtctgggctaccaaactttagtcttatgttggaatagtgtctgattgctgacaagctgagcagtagttttgacagagctaaataaggagaaaagccaagctttaataatgttgaccataagttaggaataatctcattgattgcttagtacagctaattctattttctgatgataatttgcattaatatattcagtttatgtagcttagtctccaatattatctcggtaatcccatcttcattcacagtggaacagaaaagacagagttggaaggcttgtaggtcaacgtaacaaacttgttctatctgctggctctcagattcttttcttttaaaatatgtttttaaatcaacagacaaaaattgtatatgtttgtcatgtacaaatgttttgaattatgaatacactgtggaatggctgaaaggggttaaataatacagattgagtatcccttatctgaaatggcactggaagtattttggatttcacattttttgggattttagaatatttgtattatacttaccagctgagcatcccagatctgaaaatcaaaaatccaaaatgctccagtgagcattttttttgagtgtcacattggtgtccaacaagtttcagatttttgagtatttaggatatcagattctcagattggggtgcttaacctgtatgtgcattgtgtcacatagtttattatttttttttgtagtgagaatgctcaaaatatactcttagtaattttcaagaatacaacatattgttataatctatagtcaccctgttgtacaataggtttcttgaacttatttctcctatttaattgaaattttgtatcctttgaccaatatcttcccaacttacttatactcccagcagtccccagtaaccaccattctcctctctgcttcaatgagtttaacttttttaggatccacatataagtgagatcatgtggtatttgtctttctttgccaggcatattttactaaacataatctccaggttcatccatgttgttgcaaatgacaagatgtcctttattaaggctaaatagtagttcattgtgtacaagtacaccacactttcttaatccattcattcattgatggaaccgtagactgattccatactttggttattgtgaataattgctgcataggagtgcagatatctctcctacatactgatttcatttcttttggatacattcatttcttttggtgggattgctaggttatatgtataataactgtatttttaattgaggaatctccatactgttttttaacttacattcccactggtaatgtacatgggttccctttttcccacatccttatgaatacttaccttctagctttttgataatagccattttaacagatgtgaagtgatatctcattttggttttaatttgcattccctgatgattaatggtgttaaacattttttatacacctgttgatcatttgtatgtcttcttttgaaatatgtctgttcaggtcctttgcccatattttaattgggttgtttgcttaataatgagttgtttgagtccttatacatttttttatattaaccccttatcagatgcatggtttgcaaatattttctcccattctgtaggttatcttttcactctgttgactgtttcttttgatgagcagaagctttttagtttgatgtaatcccaattatttatttttgcttttgttgcctatgcttttggggtgacatccaaaaagtcattgcccagactaatgacatggagttttcccctatgtttccttctagtggtttcgctgcttcaggtcttatgttgaagtctttaatccactttgagttgattttattatatggtatgagataagggtctaatttttttcttctgttgtggatattcagttttcccaacattgtttattgaggagaccgtcctttctgcattgtgtgttcttggtacctttgtggaaaaccagttgactgtaaatgtgtggatttatttctgggctttctattctgttccattagtctatgtgtctttatggctttcaaatattgtgagacagaagaacacaggatacaccctcttcacacttgccattaatagcccagtgcagccagaatgaacaaggtgttacagaatgtgatgcaacaacaagggagtgataattttattttaatttaaaaaggcattctcagaaactgaagtttaaataaaccatttgtttaatggctttaatgtggacactagaaggcacaaaggtctgggctattgggattccagtccattttctggaatctttgccttcagagggcataaggtaatcaagtacgtgggaggtaagagtccaaatgttctgtattactctcatctttctgtgaatgaccaaattcttctgcttttcactggcaatcatatattttgtcaacttgtgaaaaaatactctacaaagatgaaaattgaccttataaagattcttcacatgtatcacatttgagaaggttgtgttcctgactgaagaatcttgccttggtttgttgactctggggttacactgtgtccagttatggctccttggatgaaggccctgtgttgtttttgagtcagctcactcagctttctggagggcagttgattccatgaaaatacttgtctatgtgatcaagcagtgggggctgaatgtgtggctcttcacaacagaatgcaaggcggattactactattcctacagtgctactgttattattaattttaaaaacatacaatgtcattatcaaccttgatctgctctgcttttgtattttagtaattgattggatgagaatgtgcccaggcatgctttaatcactggaagggcaccagggtttaatcttccaaaggggtttttcccattgttatttcctgaaacatgcttgccattactcaagtggcatacaaaataaaattcaaatcaaaacagcaaaagagatgtgatccctctcttttgtgccttcttttaggcttaattctcataagtagaacatatctaagaagagtaggcttttgagttccaggcatactacttctaaactcttcacttaaagctagcacattcacctgaccttgaaaaggtgaatagatacacactgctgagattaaataaggcaccacagaagaataactacaggaggagcaagtaagtgcaataccctcttgtatgaagtgtgaccaacctgaattaaaccatatttctagtcctccctcagctccaaacttttcagagcttttgctcaatgactccaccccattgtatccttggctgactctcataattgcctcattattatattttctatataatatgcatctttggattcatagcccaacaatctcagctggttctcctctgtagtttgtttagcagacaattgtagtcattgcccctcagcccatacaacatgggggatctggatggaaatgaaacgcagacttggctcatcagagggcagcttggcttcacttgtatgccacaaacattgtcacctcataacactgacagtagtcactgatgagcacatttgaacccattcccaaaagtgcattgcctccacaccacatgaattagagccatttgtgttattttgcttatgtgttctttttcttttctctgttgtgtattcagattcccatattagttttccttaatctaagacttacattagatgactctagccagactgtcaaattatttgagaactctctttgtagctctaaatctagggtagtacctggtagtcaataattatttatcaaatgaatggatatttttcaacacttactggcaatcaagaaataattgtatttctaaaacagtgtgaaaacacgatgaattgaattgaattggcgagaatagaatataaactgcataactgtaagagatagtactatacaatagtgctgatgacattttgttttgctttattttattttatttattttctggggctgcctgatacaaaaagttccttgtgaaaagagaagattggaatccaattagtagattggaattgatgagttagttaagggctttagcatcctaccatgggctgtggtttttccccctgaacctatgggcatgttttgattgaagatgatggctggaagctgccacgtttgaagggctagagaaagagcctgggtttcctgtgtcagatgatacaaactagaaactagaaacgctacatggtagggaggcagtgggggacagaagaaaagacatcattattctttgtctcttcttttccctgggggaaatgttggcatccaaatattcaacagtaggttgacatgtggaaagtggcctagccaaaggatctgtggtgatcgggagtcataaatcagatatgagagggagagaccatatggtgcagaaagaaagtgacgatgcgattctttcagctatagccactcacgtgcactctcttacccagtagagagaggggcccctttccactgtttcttttctacttccccagtgaacctgcaggaatgtcagctgaaataccttgctcttttctacacatttctgaatcagccaagatgtcagtgacctggaaaggactcaggtgagagccagagaaatgattaaagagccggtgatgccgatgatccagtgggtgtctcctctccgcaccactagaactgacttatgggaagatagtcaaataactagatatgtgttgtttggcccagggcagacaagaaggaaggtatggggtaacttgtctccaatggagttgccaacagccaatgaattattgtgtcttttcctctccaaatggactgtcagtatacatatatatattttcaagttttattgaaaatagttacctcaaatttacttgcacttattttcctgagagtctgaggaatcacattctcattgctgcaggcccccagaagttttgaaacagcctctgccacgccacgcaactctactcacccagagaaattgccttccctcttttccctcaacttgtctggagatgaaaaggatgagattgaaaccccttttcttagagacacgtcccctcccttgctggtttctggcttctcttttcggtgtgtgagcaaaatcattttattaaaccatttgtcagggggcagatgggaagtctgtctttcccattagttagcagaaagtgaccccagcagctgtggagggaatcggtcaagccattgctaccaaccagaccagggtggagaaggaggccgggctttgctcagttgtcacaaggtcccaggcggctccccaggagccttggaactgatgaggccctgtttttattggccatgcctgtggtaggctgacttccttcactctgagcttcaggccagccagggaagggggcaggggccactagcattgggaagctttcgtactttgcccttaacactccatatccctgtttaattaatttcctaactttgtgggggaaaaagatgaaataaataaggccaactgaccacttcataatttgtttctgaagcttggctggacataaaagtctcccttccaaaaccacacggcataatttattttacgattccctctcggcaccaggtctgggctaaccttgagtttggaggctgtgccttcgcttcctggtgctggtggtcacagtgtgtcctttcttggcagtggccatgggcccagcaaaacagacctctgaaaggcgagcagattaatcattttgaaggcatgctcgcctcaacagttcccctgcaggatgtcggagaaccggagagaggggactgctgtagttcacaaggggcatagggaaatgcctgaagactcacaaaaacaagggggtgaacaacagaaaaagaatgagtgcttttaaattgtacatgctggagttttcactaaccgaaaagtattaccaaaaaatatattgccactcctagagcacaaactgtgatgagtccaacccttttattacaatcaggctttctctaaatatattatgccctgcaggtcaaaatgatttacttctctattttgggacatctgagttctattctactgttgccagtatgttttcagctgtgccagaaccgagcaggtctgcggctcctttgtaacatcaaaacggagacatttatcattgagatttatcatgggacagcctgccagatggtttgggtattttaaaggtgaactgtttgggccttgattagctcatgcggacttctagctaaagacaactctatcagctgctcagtggaaagacactgacgtccccctccccccagctccctccctctgttcttctagtaatgcagaaaatattaatgtaatggcagatgtggcatagattgtcatttcaggaagaaaaccaagccataaccaattccactgattgcattctaattataatgtgacctcctgttgctttgcatagaggcagtattcatttcagtacaccactgtaaaacttgcctagtcaacgaccctcaaaggggcaattgtaagatttaagcttggatttttttgctcataccaaagtcctttattctgccaagcctctgctgattgggccagaaagaatgcatttgattatatagactaaacttattgggaacagaacctctgtgctttgaaatgcttttcattcaaattacattcagacattcaatcaacattgattatgatatggattggcaacagggaatgccttgggtttttggtctggcttgaaagtttgctgagtttcgtaccagataacaactgggaagccagctgagtttccttaaccttttccatgagtttctcagaaaaggatggtttctcttgggaggccaggagttccttattcccacttgatgcagtattccaagatcatttcttcacttggaaaatttgggtctttggggcttccaaatttaattaacctctgatagctttgggaaatgtgtgctcatttgtgtttatgttaataaagtaggtccttgactttgtgcatgaaaatctaggagaatgcatcttagattcagattccaggtctaaaattttgtatcatggaagaaagtgatcatcactaattctggtcatagatgttgtctgtgtgatttagagcaaggctcagttttctcatctgcaaaatgaaataaaggtgatcccaaggtttaatttctaataaagttgatttgaaaatactaagaaacaatataatattgttattattatttacatgtcagtgtatgtgcttgtgtttttgaggggcctttgcctgcatctagacctctctgtctctggaaaaatcctggtgggatcagttttcgaagtagttggctcttggcagactcgcagacatactaaagtttttgttttgacttgaaggtcctcttccggcccttctgaataactttaacctaaaagtcaggctagaattcccacaagaagagagttgccagggcatcctcattccaagctataaaatcactggagatagctccattttctttatccaatcacatgccatgagctgtcatttgtgtacagatgtctctcaaatatagatttccagccttcatagcattcctgaaatttagcattgctaagtatatggtcaccttgaatagtattctaggatctcgaattcagtacgttctctttttccccccaaaacaatggcaaccagcctctcctctgttctctctttctcttaactgctcctgtagttccagttactagagttcaaaaccttggaacttttattttctcccttgtctttacttcccacatagaactagttgccaagtcctgtgaattataccacttgaaaatatctgttcttcctaaagttagtgctttttcattgagtctaatcatttccttcatggcctgtgtaatttagtctttccaccaatccagtcatcctaccatgatgtggcagcagcttctaagatggtccttataatatctgttatctggtgttcatacccttgtgagatctcctccccttatgtgtggatgggacctgtgatttgcttgtaaccagcagattatcgaaaaaagtaatgggatgtcactttcatgattaagtgacataggattgtgacttctgccttagtagaaaacttttttcctgctgatcttgatgaagtaagaagctatgttggagaggcccacacggcagcagcagagggtggcctctggccaacagccagtaaggaactatggccctctacccaagaccccacaagaaactgaatcctgtcaacaatcttttgagcttggaagcttccccagttaagcctcagatgagaccccagccctggtctgtaccttgataacagtcttgtgagatgcctaaaacagaggacacagctaagctgtatccagattcctgacccacagaaagtgtgagacaacaaatatgtattattttaagctgttagatttgtggtaatttgttacctaatattagacagctgtatcctagagcagctagattactgcctgacaatatcagtcttttgctcagaaatactcagtgtcttcatgattctttgtctttggccttgaactccctattcaagctgttttccaattctccttcctgagcacaattacctctgtactgttcatatttctggctttctgccttttaccttttgctgacatcgttaccatttcctggattttctttatgactaaatctcacatcttttttaaaggcccacttaaatgtcacctctttcataaaagcttttttgatctctgaagctatatagatctctgagctgccatcgttctatacctcaggttcctattcattttctacctcataggggactggtttgagaacattgctgtatctgtactacaggttgaataccccttatcaaaaatacttcaggtcagaagtgttgagaatttggggttttgggggagattttggaatatctgcattatatgcttacctgttgagcatccccagtctgaaaatccaaaatgctcatttgagcatttcctttgagggtcatgttggtacataaaacattttgggtttcggagcattttggattttggattttcagcttagggatactcaacctgtgctaggctgcaaattatatgaaggaggcttcttctgattcatctttccatgcccttgagcttccaatataatgacttaatggatggtatgctctcagtggatgagactcaatggatggtatgctccagtgactcaatggatggtatgttcttgttcatgaagagcaagccagtgtgcccacaggacagcaaaacagaagtggtttgtggaactattcgtttatttacttgcttattcttttattccttcctttaccgcatacctggcattgtcctaggggctgatgtggactcatgggcatcatgcttagaaagggaccttgttcttggggttttatgtttaagcatcaccatcttcttgagactcttaatcattttatttttgaatctgtgttttctgagtgaagtcccagaaggtagtggggtatatgctaggggctcagagaatttgccagtgccttctgcctccctgacatagattctaacccacttgttctcctcaccctcccaccatggcagaggcctgggcacaaccacagggagagttggggttgggtacacatgccctgtattccaggtcacagagtaaggaccctgggtacctgggaggatctgtacttgctgcatagtcaggaagtaactatgtaagtatcatattaaataagaaatactatgacaggttgagagaaagagaggagagcattagtgagcttacagacaaacaggaaaagcttttctcttgccttttgaacaagtgcctgcattttcatttgtactggaccctggaaattatgtagctggccctgactaggggtatagtgggaaaccaaaggggcagggatacagctgtggcagcagaggtggggtcgggggaaacagcaaacaacagacaataaacaagatgatttcagaaagtcataagtactatgactttctgagaatcaaatgaggtgatatgctggtgagtccctgagtatggtgcaggaagcatgttaccttaaagaaagatgatgagggaaccgttgctgagaaggtggcatttgagtggacatctgcaggaggtaaagaggttaggccgttccaggaatatggggcagtttctaggcagaataatgtgctaggtcaaaatccttggggctggaacaagcttgaaatagccaagagctagacacaaaagccagtgctgcagtagcctagagactgtggaagagaggaggcttggggcatttactaaggtaagatgaagctgatcctttattttattttattgttctttttttagaattaggttcttgctgtgtcacccaggctagagtgcagtggtgggatcatggctcactgcagcctcaaactcctggatcaagcaatcctcccactttagccttctgagtagctgggactacaggcgtgtgtcaccactcctggctaatttttaatctttttttgtagaggtagggtctaggtatgttgcactggctggtctccaacttctggccccaggcaatcctcccgccttgatcaccataagtgctgggattacaggcaggagccactgtgcatggtccagctggttctttaacaccaacaccatactggccatagtgaggacacagcttgcctctgggcttgtctaggtctgtagtccagtattttcacacctaagaattactaaggagggattttacagcaatgcgctccctgcattttctaccttaatttaattcctttttctttgtcaacatagctattctgcattctttaaaatagagattttttcagagacatgtaacttacaaggatgtaaataatcataggtgggccaaggaatgtgtagttcctagggagagctttgcaaatgagattggttcctttcccacagaacctcaaggactgttggatttgtttcagaggtcacaaatgggcaccttatggcccaaactggagccccagaagtgttttatttgttctgcatgttgcccttcatcaaacaggagtgccccagcaatggccctgtgctccccagatagctctgtcctaatctctcctatagtctcctgcttgtgcttcttccctttatgcctgaactctttttaattgtttctcattaaaaaaattatactccactgtatagtgcagacgtggaaatgttggcatgtggatagaccctgtaccaaaaacccagcagaagattcagagtccctgagatgcttcctcctcatcttcttcgccaagcacctcttgtcactgatcttggaagttagaggtgggaaaaggcaggtaagagggccaagaagtcaaagtcctaattcatgcatgcctgggcccacccgtcttcccgtcttgcatgcccattctgtggactccctatatgtagatgctaacccaggaaacccctcagggccagtggtgcatggctggctcccttcctacagactgttcctttaaaaatttggggctttaactgagaagaaaattaagtaattttgttattttttccttcataaagctaaaattattaatcttcagagataagtactgttcagtgcataatgagttcgaattgttgataattataattttgaagagtttcagcttgctgtcagccaagtaattaaaggggtgggaccagggttctattttgttcatgatggttatgcttctggtaagaactctctctgtgtggcaaaaatgccctcattctagtcacatggtgcagtgaaagggttaattaaatcaagtaaagtaatccactgggttgtgaagagttctcttttcctagtttcccccctggccttccatctcttccttaagatcttcccattgtcttagcaaagctggacaccctcaatggtgcccgctctccactagtgaaacagatgcaggatgcctgggtcctgcctgagcccagggaagaggctcagttcctttccctctttcgcaactgcccccttcacccaattgcccatgagtcaccttaaaaaaaaatgtcttgcatatactagcactggactaaaaaaattgaaccaaaagaaaagaggaagagaaaatggaaaactaatgattcaagaaatcacatagcacgagataattctattttgaaatcacagcagtggcacccagaggcggacactccccaaattactagtgaaaaccctttgatgtatccagttgtaagaaagcccaaggcacttttttattattattatgagtgtttcacattccccaaaagaaacatttagcagtaatttttaaatgtctgtgtgtgagcaagctaaataaaatgaaataaaataaaataaatccctaaaaaatctccaaccctaaatgtgcttacttgatggctggcttttacttacaataaaagccaaggtcttacaatggtgtatgaggcccccatgagatctctctgccctcatctgcccctttatcttccctggctcattccactatagccacactggctcgctagctgttcagggacacactgggtgtgttccctgctcagtctgttcccttgctatattcccagcctggatgctctttcctgggtatatgaatggctcaatcgtttctttccttgagctgtttcctccaaagtctccttctcattgaagcgttcccttgccatgctgtataaaacctcaacttcccacttttgacactcttaaagggactttgcagatgtgattaagttaaggaacttgagatggagagattatcctggaccatgtgggtgggcccggtatgaaaacaaaaatccttataaaaaggaaacagcagggatacaaacagggaaaggagatgttacaacagaaatagaagttggagtgatgtaagttgaagatgaaggaagggtccacaagccaagaaatgcaggcagcctctagaaactggaaaggcaaaaggaaatgatttttttctggggccttcagcagtaaccagagcagttgacacctagatgttattagctcggtgagaccctttttggacttctgatctccagactgtaagataataaatctgtgttgttttaagccactgagtttaatttgttacaacagcaataaaaaactaatacaattggcaggacccagactcataagaccccaaagaatttgaccatcttggtccccggttcttctgtgcaatattcaaagtttctattttctgtcaggatttcctttctgacttgaagacagaggaaagaaacctttgcagtacatgcattctggtctccttttgtacctgaggccagctttcgtcactaggtgcaataaacgctgcattagattttgatgggaggtatggtgcccaggtgtgtttcaacacagttcagatgagggacaggggagctggggagaagcaaatgcagccctgccaggaacagtgcgctgctgtttatacaacagggtaaaggaccagacttgtcattattttaacccaagtagacagttctcgcctgtctaaggatgtgattgactggtggtatcttttcatggttatgcagcagattgaacttcagaagtcagagctcacaactgacgggatgtgtttgtaattggacctggtaagaactggacctctaaatagggaagaaagagcagtggagacaatcacattgtggccttttgctagttattcattcatagagttcttcctgttttaattctggaggattaaaacattaaagaataatttattcctatactctcctcagcccccgtgcgttcctttttccttttctgtgtctcttgttttatctttctctctctgtgtcatacttttccctgaccttccatttcctgaaaattgtctgtatttgtgagggtaaccttagtgcttgaaactttttccagctttattttaaaaagatgaccattttatcaggcagtctgaaaatccaaaagtattctctgctccaaatgtcctcttatttaactggccagcgaggaaaacccacaaattgccaaacaagaggaacaacaggaagcggtgatggagctcatttacatctgcatatgttctttatttaaaaccaggggaagtgctgagtggatgggtttgggaaatatggccggcattccggaaagggtggctgtgcacaagtccacacatcctgtactaacaggcggaaagggaacatcatggcatttatgtttccgtgccatcttttaatgtctgttctgtggcatcttcattagatcccaacatgacccacaaactgttaacatatcaaaggcagtagggagagaggtgtgaatatcctaaaagggcttctgatgaactatcgtattttcttatactctaaatacatggaacagagatgttgggataggtacacatttgggttttattaacaaaatagcagtaagatgtataggcagttggagatacccgttgagcctctatgttctaaagacaaatgttccagcctctcatggtcttttggtggcacaaaatgtttcctcctgaagaggtgaaaaggtgaccacagtggtccttctcactttgctctgcctctgtggctgtcatgggagtagagttggctatgacatctgccctgcattgatacacaaggctgattcagggtgggttgtcaggtgtcctttcattcatcatgaccctgagtatgtcccttctgaaaggaggcatacatggtgaaaaaaggggccttccctggagcagatttgtgaagcaaaacatgaaaccttattattggtccatagaatgagcccgagaggcccttgagatggtctttgatcctactcatattttaaggtagaaaaacttcaaagttttaaaaaaactcagaaaggctggaataattgttccagatctcagtacagttgagctacagttcactcagtcatctttcccacttcagaatctgcccattcgtgcaacctttgatccctccatccacccacaaacatttgttgaatgcccataaataagatccagtccatgcctcaaaaagctcatatgcacaggaaggatgggaatgtagggctgtggactaggtgttacgcagagatgtggcagctgaagggtgcacagaacagggagtgtgcacatcagcctgggctctgtggtggagagtggaggaaggcagggagtgatactcaaagttgcggatatgtcttaagagaaaaatagttgtttgccaggtgctccatatgtgggaagactctgtcctatcctatttctatttgcttttaaataataataacaaacaaaatttctattgtttcattgattctctcattcactcaaaatttgagggcctgagatacccagaggagttggaacacacaatctgtactcacgtggggacttgcaaaataatgaataaattaatgttctagaagttactgggaccagttttcatccaatgcaagaataacttctaagttcttctcaaccttgagatttgatgaattagaataacgaacctttgtctcgttatctcatgcaactcacaacaaccctgtaaaatagattttatgatcactgtcagttttataggtaagtaaaaagagacacaggaggggttaagaaatatgcacaagatttcatagccaaagggtgaccacatgagagccaaaactgtctgctatccttaaatcctaggttatttcttttgcattactttgtgttgcttatatatagttgaactcaataaatgacttcatataggtagggcaatttcttcatttaactacacttaataggagaccaaattagaacatttgttttgaattaaaatatgatctttaagacattcctattaagaagggcagtatgttaaacatagagttttagattatcagagctggaccttgtacaaggagataataactctcaatacaattatgtcattttctgccatattacagatgagagagaacacagttttaaaatcatagccaagaacgcaagtttccctactcctcccagtgttatctcaactaacacttactgctttttattatattcagcacctgtaaggatcataacccaaagaaaggaaaatgcagaacaattgggttttgatgagagtctgagcttcagaagggtttggaacatacaatgaaatttctcattccgtggttatttgagtgttgggatgaggacaccagcgcacaactgtggtaatgtctgtggtcaacagagagcaccaggtactagctggatttggtggagcccaagtagaactagacagagggccttgaatggtcatctaactatataaaacactcacctttgattaggtctgctctctagtcataattctgacctctgtggagtttacttaaaagcataattctcattgattatgtaccgagaattatgttctcataattctcattgattctgtaaggaaatgtcctatgcacatggttctagaaatataaattactcctgtcaatatttaaccaaaaaccagacttggtccttcaggtgccagggcagagattgctcatttatattgatgtgattttcactaaataagagctgtaatgtttgaggatcaaactgtccagtttttgaaattagctgctttttgaaatttcctctgaagtttgcctttttcattttcccttttgtttttctgctggtttcttctttctcctccaaagccgcaggactcctgctacattgctcaattctactttccacctccactgctgggcaatttcttccttcctcactcccgggaagaaataattctcctcttgacagctttcctttggtggtttgcatactcccctcatgtagtagtcacattataaacatgcacagatggcttcggaaccctgggcttattttctccctattgtggtacaaggcatttagcacctggtaggagctcaaaaaatattttaggaatgaatgaatgatggaagcaaacaaagaaggaatatttgcctctcattactaccatctggagactccaaggaggccctatggttcagtctactttctttcagtttaccactttgtgtcacttgtccaggtgattttaaataaacattcattcattcattctgtctctctctacaagaggatggacacgtaccacactcaataatggtgagattgtcagtgattttcgtactcttttcctttgagctttttggtagtttgacatttttctgcaatgagaatattttattttgtagttcaaaagtattagcccttttatgcccagtgttccattattggaatgctaagcttgtgggagttatttatatcctactactcaaggtcattgccaaggtctgattttttgtatacaaaaatagcaacctctggcacaaatgagttaacattagatttttaaaattatattttgtattctaaaaatgtttattttataaaatttagacaattagtaatattgggagaaaaaaactacccataattctgatacccacaatccattgctaacccgttcactttacttctagcctttttttagtgcatacattttgatatgtagttgtgatcctgttgaaaattgacatttttattttactttttcaatgaacatgtataaagtggttttatgttatatatctccatgaatttcacttttattgactgcatgctagtctttttaaatattaatatcaagtgcatggtcaactttagcatttcccaatatgtaatagcaacactaaagtgagcatttattaaatgcttgctacttactgggcagtgtccagaataaactggtaggcaaaatgaacttctgctctcccagaggatagaatctacaaaaacaaatttatgctagcgactcaatatggtaacagctttatagtgaacatgcagagttatgggaacatttgaaggaatgtagaatccaattttaagcaaggattagggaagtcttcctggaagaggtaacattgaagcctcgacaaccgtatcacaactgaccagggagaaatgtgagaagagttcaccttgggggaacagcatgtataatgggccagagggcagaggcatggaatgttgaaggcacggaattgtagtttggccagagatcattgtgggaggggatagagagagaaaaaggagagtaaggaggtgatcgaggagctaatagcggaggtgcatggggtaagatcatgaagaactttacatgcaaatttaaagagtagggattatgtcatagaggcttggaaaaatcactttctttcttttttttttttttttttttttttttttgagatagggtctcactctgtgacccaggctggagtgcagtggtgcaaccatggctcgctgcagtatcaacctcttggtctcaagtgatcctcccatctcagcatcctaagtagctgggactataggcacataccaacatgcctggctaggtttcaaattttttgtagagacagagttttgccatgttgcccaggctagtcttgaactcctaggcttaagcaatcctcctgccttggcttcccaaagtgctgggattataggcatgagccaccgtggcccagcccccatcaagaagctttaggctggagaagctgaaagattacattggcttattacaaagatcattctggctgggagtggctcacacctataatcccagcactttgggaggccaaggggggtggatcacttgaagtcaggagtttgagaccagcctggccaacatggtgaaaccctgtctctactaaatgtacaaaaattatccaggcatggtggtgagcgcctgtaatcccagcaggctgaggtaggataattgcttgaaccctggaggcagaggctgcagtgagccgagatcgcaccattgcactccagcctgggcaacagagcgagactccatctccaaaacaaaacaaaacaccagaaagatcattctggctgccatccacagatatatgcagggagaccatagagggggttggagcaagagatgcaattcatgcaagagatgtttgtcatttacctgttgttgtttttatttcaccatcataataaccatgagaggaaatttttatgcatagctatcttgagtactattttattagaaaagaataaaaggaaaatgcgagctgatcttagtgttacaacttgtcagcgtcacttgcaggctgagtttgttctcatgcccacctaccaagtcatttcagtagtacctgttggagatgcgtaaagggcaccttcttgaggatggctctccatagtatacgtggttcagaccagatttcatccagatttatgctgcatcatttgctgggatctcaacttccactctaagcctagtgccagttctgtacaaatgatttttaaaaatccaacataattaggatgattatatacaccttacagccatgtttcatggactccctgggtggaatgcatttgcctaaggtcaacgacattatttccctaaagggacagtcctattgttggacttcagataaattcctcactatttttcaagtgctccagtttatatgattccactttcttggccaaaattctgcttatggcatagtgttgcccattgtgggatctcaaagcacattcattatcatgtgctgacggctgttctgcaggagtggaaaatggaggtagagagaagtgaatgcaacggtgccagcagtgggggatggagccacgcccctgacagggggcacagtctctgaactcagcaccaggctgggaagctttgccggggcctccctgtgctcttttggggcaggccactttggagacataacaaatataaccagggtagagctctgccagaaagcaacagcggggacagtgatggaaaacagatggaggcgctggccttcacttggtgagaaatccactgagggaatggagaatgtttgcaaaatctccgagtgctattgggacacctcttagtgcatttacaaggcgccagcctctgtttgccaatggtttagtttggttttgatgagaccaaattaccctttgaattctctcgaaattttgaacatttcccaaattttgtttgactcaccagctggaggcttggaattaaaaatccagcatgagtgcctgagaaaaataagtgaaatcttgccttattttggaggaatggttaagaaaaggtgcttgtagctgcctagcttgtggttggctccccacattgtgtaattcttagcctggaacaaatcttgagttgtcattttgtattttctcctgcttctacatagggagggagggctctgcctccccaaagtatttcggaaagatggtggactcttctgatgtaagacttcagaaaggaaggcacacaaccttatttgttcttctgattcatggataaagggttaaccatactgtggctttttgtagcacatgcagtttgaacatagctctatattcaacatcttgtggtgagaaggaaggacacaaaaaagagttcatctcctttctctgggggactctgccctttctaggtgagatgatggtgtatgactctaggaatatagataagtgtccttacatacaaagcagtatgattcgctgtctaggggaaagatacaggggaattgaatgaggaatgattctgcattcttagtctctaagatgttgaacctatacaatattcagtaagtagttttgattcttctgtgatgcccctatgcccacaaacatcctcccatcatctcagcctgaaaacaccattcctgcaatcttcctcctttccctctctcttgctctcatgccaccttctttgttttgctgctaaatgctaaaagaataatttagacttgttgcctttcctctctctctttcctgctctcccttccttctccacttcttcactcctagtcccctgacttccttcctcctctctggattacagctgttctcctggtcagcaatccaacctcctcttcacattctttgccttactgactctttggatgagtcctggtgattccagaaccctctgtctctgagcttttatgccactctctcgatgcttctcacatatctctatctgctccctttctcttcttctcacatcccttaattgtgaccttttttcaagattctgtctttgagccctttctttcttttcgacactcctagccaccatgggatctttagcatctctcctacatagatgcctccatttttagctttccagctctgacttttgcatgagccacatcacatctgtattagtctgttctcacactgctaataaagacatacccaagaccaggtaatgcacacagaaaaagaggtttaatggagtcaccgttctacctggctggggagacctcataatcattgaggagggcaaaaggcacatcttacatggcagcaagcaagaaagaatgaaagccaagtgaaaggggtaatcccttacaaaaccatcagatcccctgagacttactcactaccatgagaacagtatgggggaaactgaccccatgactcaattatctcccaccgggtccctcccacaacacatgggaatgatgggagttacagttcaagatgagatttgggtgaggacacagccaaaccatatcaccatctgattctcaaactaaaaaatagtataaaatttatctattttatttattgcatggtgttcctttttagaagaaagctccccaaaggcagggatgtctgtctgtgttgctgttctatcccaggggcctaaactagagcttggcacacagtattggctcaccaaatatgtgttgaactaatgaatgaatgttacctacatttattgagcacttgcctggtaaagaaaatttctaataagatgattatctcacatcatcctgacaaaatcctatgaggttagcccattcataatacaattttgcaaacaaggactgtgaaacaccaagaaggcaactctcctgaggccataaggccatatggctggtgagaggcagaatgtagacttcaaacccaggcagaatgacctaagcccaagctttcaagcactaggttgtacttggaggtgattgatctctgccattgactagctatatgaacttggacatgctttttaagttatctgagcttcagcttcctcatctagtgaaaggacattacctctgacttaacagtgttatatctaagaactttgcaaacagtaaaatacagcattaatgttattcctcaaataaggtatcactaatatttatgagaaaaattacatacaaactctattaggacttacagagccacaaaacaaaccagaaaccaaccaaacagcaacaaaaacaacaaaccacaaattatgaagttatggtgctatacttcaaggaatgcccatcctttctttttccctcccttccttccctctctcaaatatttattgcaaccctacaagtgctgggcctgggctagagataaaaggataaaaataattagttgagattaagaattagtaattagttgagattaagagattgatttatacttctgataagggaaagaataatgttgactggagttcttgtggaacgctgtcatgagagggcctggaaaaggagtttagaagactcaagcaacagagaaaaatggaagaactatattcctctgtgttctcctcttctgtgtgtaagatttgtaaccctgagaaaactggttgagccatggcttagctggctgcccgagtcatgggccccttaaaatcttcacttaggtccccatggatgccagagagggctttaaaggtgactgctagatcaccagcctagataagaaccaggggaatgggaaagtggctaggaaaggagactcatatttgaattggagatgtcaggatagtcaggcagaggcatctgcagttatgcagcagagtaagaagaaaaggagagcgaggcttcataagcacttggttctttggctgagggtctgaagaaatcctccaagacatgtggcatccgccacaactctttgcccacatccaggcccttccctcttgggagcctgtcagaggggaaaagcaagtggctccatgtgtctctgcctttgtggtaacttggcttctttgctggagggatcagttgagcatgtcttcaatacattggtctggggaccttctggttctctaaagctgacagatttctgctcctttttggacttcctaaggttccatttaagttttacagttaagggttgacataaagacatcagtccagagtctgaatcttctcctgccttgtttaagacctgctacaagggctttctgtccagaagagctttagttccatttggggaaaggtagataaagctgggtgctgtcatttttttttgagaagtagcttagtatggacacaagagctgtactctgagaataaggagtcttggattctagctcctgggtttgtttgtgtgacctggaatatgttctgtcccatacgttctaggcttcagtttcttccataaaaagtaggagttggactaaatggtatctaacaccagtttccatattaacattctctcatctttggctggggcgtgtatgtgtgtgtgtgtgtgtgtgcgtgtgtgtatacagatttttctggaaaagaaagattaaggatacgatcccatacacactatcatcaccatatgtgcgtgcattcctgacatggctatgggccccacccatgccatatgctccccacactttgtcagcctggctgtcctttattgcccatcatagctcagcctgccacatgttcctgtgcgcacgagatgcactgacacaggctttgtgaaggctgactccatgtcttgttctcctcgctgcttcttgaggaatcctaaatccagctgcaacctccacacttgcatggctttgtagaaggggaaatgtaagagtaggcttttaatcagctcacacatattttgtgaggcaaggtctgagagggctttgtgaagccgctattcactgcatcatgttgtgggatcaagcctacactttgtatcatatggaaacactgatagtgccagataaatactgagacttaggaagaagcatactgtacttccaaccatccaaatcgtggcagaacctgaggacaaagcattcaactaatatggcagaactctacaaggcaggactgggatggaagtttcggaaaggaaagatttgtgactctctgaaggtggttcacatgacccttgctgtggagggaaatggagtgccacctggaatcatgcttcccctgtcctgctgaggttcgtgtggatatgtgtcaaatatttttcagagattttaaagaaattaaaattaacacttgattcaaccctcagatctatcacttataatgcggcctcggacaggccatctaacttctttaagcttttttgtcctaatctttagaataatatattacctactatgctgccttttttcccaggttagttatgaaattcaaagaagatgatgtttgtaaaagcaatttgtaaacaataaattaaccagtggttatgtgctcaacactgtggagcctttcactccaaataaaaacaaatcaaaacaaaaaccacctccatggatatataggcaattttgacatgtaacttctaagggtctgcttaacaggctcatgtgtcagaatttgacaatccatgaaatagagatcaagtagtcgtaataatatcactgccttcatggcagaggctgcatatctgtttctcctattccacttcatctccccagtgctcacacatacaccctgttggtttgtagttagtgaatgattaaggaaatgtgcgtgtgcctgtgtgtgcttgtatgttgtataggtgtgtctgcactgcccattcttgcatttctatcttttaactgttatggatgtataagcactatctatgatggacgaggcatagtgcatctcctaggccggaaatgtttcactcactaatgagctggacaattctactctgtgaatttaactttcctgactcccttatgcaggttaattttggtaacatatcatattttactctggcttggtgggattaggtgggaaattacagattgcatcaacaatttggtctgcctggatacaatttggtctgtttcagtcacagcctgggtcacacctgttgatatatatttttaaactgattcctctctagatcattctttctgatcagcacaaggcaatatgctgaaatttctcttttatatctgttttattagcatgtctttcaagtgctccttaatcttccaaagaaaatggaaagagttcttatattgtgctacagcctttgtattcacttggcaattgccaacttattttaaaataaacttttaaagtgaactatgacgtatctatacaatatgcacaaatcatagtatacaactttatgaattatcatgagctgtcaccacccagacaaaaaaaaaaatactggcaatggcccctgccccccacaaactctctcatatcgcaccctaggcactacttcttcctccataaaggtagccaacattcagacatcatattctatggattagttttgattacttttaaattttctataaatggaagagtgaagtatgtatatttggggatttttgttgttgttgttcaatgttaaacagtattccaaaatattggagttcaatgtattagtctttttccttatggttagtatttttgaagtcctgtctaagcaacatttgtctactcaaaggtcatgacggtattatcctgtgttatcctttagaagtgttgtattttacattcacatttagaactacagtacacctaacatttttatatggtgtgtagtaagggggtcagtaattattttttcataaggatatctgaaaagacctgacattcctcactgcttttttcataaatcaattgtcttcatatatgtgaagttgtcttggactctctattctgtcccattagtattcttgtctcttctgggtcaatgcccttatctgtcaatgactacagttttataataatgtctaatatctagtcatgtatcaaaaccatattggctatccttggctctttgaatctccatacaagttttagaatcatatgtgtcctaataataacaacaacaatgaaaaaagatgatattttgattgggattattttgaatttataggccaatttgtgaaggattgatatgtttgcaatgtgacatcttctaattcatgaccatgggaatgttcttccacttatttaggtcttctttagttaactcaataataatttttagtttttcttgtgtgtgtgtgtgtgtgtgtgtatgcatgcatgtgtgtggcagtcttgtacatatttcattatatttatatgtatatgatttttcaaaatagtatggtaatatgatttacttattttttgatgctagtatataaagattgaaataattctcatatgtttattttgaagccagaaaccttgctaaattcacttatttattctaagagtttctagagtttttggttttctgtacacaaatctccctgtaataatttttttctttatacctattccttttatttcatttcttatcttatagaattggccatgacctctagtacaatattgaacataaatggtcttgaaagatacccttgtctcattttcaatctcagcttttaattttattatgtctaatgagtgctatagaactgttatcattatcctttatcaattagaaaaggcatcttttcttttgttatgagttttcaacatcaatgggtattgaattttgtcaaatattaaatattttgtgcctctgtagaggtgatcatttgcttttctcctttattatattaatgtgatgaattacattgatcattttttaaaatagactttattttaggaagaagtttcaggttcaaagcaaatttggacagaaaatagagtaacttcccagatactccctgccttgacacttggacagcctttcacacgatcagcatctcacaccaaagtggtacatttgttacaattgattaatctacattaacacattattatcacccaaagtccatggttgacatcagggttcactcttagtggtgtatattctatgggttttcatagatatgaaattacatgtttccactattagagcatcatacagaatagtttcactgccctgaaaatcttttttgcttcacctattctatccctccctcctaactattccctggtaaccactgatctttttattgtctccatagtttttccttttccataatgtaatataaatggaatcatacagcatgtatccttttcaaattagctttttttcagttggtaatatgcatttaagtttcctccatgtcatgttatcacttgatagcatgtttccttttagtgctgaataacattcattgtctggatgtaccacaatatatttatccattcacctacttcaattttgacaattgtttataaatctgccgtaaacatctgtgtgcaggtttttgtgtggatgtaagttttcaattcattgggtgaataccagggagtgtggttgctggatggtatggaaagagtatctcttgtaagaaactgccagattattttccataatggctgtaccattttgcattcccaccagcagttattgagcattccttacttattttccacctgtatatcttctttgataaagtgtctgttcaggtcttttatccatttttaaaattgggttgttcatttggttattattgagttttaagtgttttgtatattttcgataacagtcttttatctattgtttggaaatattttctcccagtcttttaaacattaaagcaacttgcagtcctgaaacttacccaactttattgtgttatgtgaatacacattgccacatatatgaacacaaaattgaactgttaatattttgtttatggattttgaatctgtgtttatgacaaagattgtcctagaatttttctttctggtaatgctcttattaaatgtcagtataaaattttactaccctcataaaagaagttgaggaattttcttgttttttctattctttggaagagttcatttaatattggtgttatttctttcttatgtatttggaaaaattcatggctaaactgtctaggcctggagttttctttgtggtaaggcatttaattacagatttaatttctttaagatatatgactattctattctttattatacctgttttgttgtatttttaaaagatttttaaaaattgatttaaatgtcaaatttatttgcataaaattgttcctagtatccttttatctatttttcaggtactatattgatactccccatttcttttctgatattgtaatttggtaccttttctattttactcttgagcagtctcattcctacccccatcccagaaattataattttataagtcttaaaaaagttttggctttgttggctgttttaatgtacatttattaatttcatttattttctgtttttactgtttccttcattccagtttgttggttttattttctgttccttaatttcttaggatgaataattagatcactgatgttaggctttcttcttttctaatatatgcatttattgatatatatgtctctaagcgtggctttagctgtatcctacatttttttatgacatactttcatagtcattcaattcaagatcttttctaatttctatgctgatttttttgactgttgagatatttagaagtatgtagcttaatttcccagcacttaagtgtttcttagttatcttttgttaataatttacaggtaatttcattccggtcagagaatatacttggcacaatttctgccttttcaaatttcctgatacttgctttatagcctggaatatgtttaatttgggtgaatgttctctgttgtgcaatgtctttagtcctcacgtgcagtattcttcatttgcgtgtgtgtatatacatgtgcgtatgatcaagtttgaagattgttaattatatttttcaaatcttttatttaattcctttttgttatctgcttcttttacttactgagagaagtatgctaaaacctcccactatgattgtgaaattctcctttttgtcccctatagttctgttgatttttgtttcatgtgtttttgaacttatacatttagaatttctacatcttcctgaacaaccacctcttttgtcattatgaaatattttccctttatttttagttatggtccttgtcttaaagtttagtttatttggtatttgtaaacatacactttctcttatggctagtatttgctttgtgtagtttcttttcacttctctactctcaaattctctgaaggcttttatttaaaatatgtttcttgtaagcagtatattactttgaaatccattatgaaaaccttccttttaatggtgatatatagactatttaacaattaatatagtgacatcttaactaacatttaatatagcttccttgtgacacagccgccctttttctaatagtctcaattatgtctcatttgttaaatataccaattaaattattagtttaagctatcgtatgtttcggccttgaatttttatttgactctgttgtatagttgtcatttcttttctaaattccttcatttgctgttttgcatctttagaatatatgtgattgatatgttccagtccgtggctaataactccaatatccatttcttttgtagcttgttatctcttattgattgatggtttggatctttgggcatttggttttgtctcttcgtatgccacatgatatttcatacttgacactgagtacaaaaattataggaaaaaacttgaggctctgaataatgttatattccttcagagaagacatattttgtttctgggaggaaggtctggtgggggaagattgccttagtccagttagggatttattccatgggaaactgggctgcagacttggtgaggacagatctatttccagttgcccttccacctgtgatgtagtttttcagggtcctcgctgaaagtctgggatgtctacctggaccccttctccttggcatatcttcagtctaattttgtccaccaagacttataagactgtgaagtttggttcagctactcagcctcttcattgcaggttgagaattgaaaattgcttcatgagagacagtagcactgaatgtgggactcaggtctccacacgctcactctccccaagatcttatcctctcaggtcgtcactgccttagtaactcactgaggccctgacgtaagattttctacacatatttagctcagcatttttagtttttctcagtgggagcattggtcttcagccagctagtctatctacttcactctcactctcatcaaattattttattcacactttacagatcttgaatttgaggctaaatcatccacattacaaagacagaaacccagccccgccatgctctcctcagtctgtctaatcataagacataaaaagctaagcctctttctactcaggcccctatttcatgtctcattctagggtcagttgtcaaagaaatcttgataagaaagtattaattcttaaggggaagctcttcctcatggataactgcattttattaatagagctgttttgaaggcctacagcctttgatggaaataactattttggaagaatagaagtgaaaggtttgctgttgtttgcttgggtctcagtaatacccctggggcatctacccctacacatacagccaactttgcctttgaatctcccctctccatctgaagtctttgttctttccaatggatttatagcaatttacttcctcatgaaaaaagaacttgcattcctgaatctctgcaatgaactgaagaagctaactgtacaactcaatcctgcccacaagtgggcaaaccaacaaaaccctttgagaaagttatatcctattttatctaataatggtcaagatgcaaaagacgtgaatgtcctcttttatagcaaggacaaaaaactccacgaagatgagtgtatttaaaaaacaaaattgaggccaggcgtagtggcacatgcctgtaatcccagcactttgggaggctgacgcaggcagatcgcttgagtccaggagtttgaagccagactgagtaacatggcaaaaccctgcctctacaaaaaatgtaaaaattagccgagtgtgatggtgcacacctcagtcccagctacttgtgaggctgaggtgggaggatcgcttcagcccaggagatcgaggctgcagtgagccatgattgtgcctctacactccagcctaggcaacagagtgagactctgtctcaaaaatagtaataaaataaaataaaataaagctgcttattagttgtttgacctagacataaattcatttaacttaccatagccttgatttcttctctgacaaaatgggcatagcaatcataccctttcataaggttgttggctgggttgtatgaagtcattcatgtgattattgattaattgagtgatttttcagatttcacaagagtttgaaataaaataattaaaaattaataaattttgttataaagggaatggcactgtttcaaacttagctgctgctattgctgctgtttggtaataaattctagtccccttttgacttcgatcaaaatctgatgccctaactcagctagaatgagttttcccattgcccatgtgtctatttttgttaaacggtggaccctaatcaaccgaggaggtgtttgttatagaaaaccaatgactaggaatcaccttctcagatacagaatatgaggccccaaggggtgaggggaggtgtccatggttactagacctgggggtctcctgacttctaggctgcgagggaaaatatcacagagtatgctctgattcctagagggccagaggggctcctttgtgatcccaagttctggttcaccttctatatggagttgtgttctggtcttaagggacttacccttccattccatcactttctgccatcaaaactttcctttctgttttctaagacaatatcaatggctgtggatattgaacaattgtctgataaaagtgatttttgacattaaggatctaagtgctcatatttgagagtctgatctagtgaccctcatgaataacaatcacaccttacttagtactgggattttccctttacagttgatgtttacttacatgattgacctgcgtaacagtttaaaacaggtaggaccacgaggtcaggagattgagaccatcctgacaaatatggtgaaaccctgtctctactaaaaatacaaaaaaaacaaaaaaattagtcaggcgtggtggcaggcacctgtagtcccagctacttgggaggctgaggcaggagaattgcgtgaacctgggaggctgagcttgcagtgagccaagatcgtgccactgcactccagcctgggccacagagcaagactccatctcaaaaaacaaaaacaaaaacaaaaacaggtaggaccacaacagtaacaataactgccattcatcaagtgtattttgtttgcaaaaatatcttcactttcatttcttatttaattcatatgctaatccttcaaagtgggtgatatcattacccatttaataaaatggcaattgcagctcagaaggcaaagaatgtgctcaggatcataaagccagtaagtgatgtagagagattttcaacccagtttgttgattaggcaaaacagtagtcttttcacggcaccttactgtctttcccaagttatttctccaacctgtacagagagattgtgccttgactaaaaagcgccagcaagtttatgatgggtggttgagtcaggagtagagttttaatcttctaaaccttaacccatctctctttctattgaccatacacttttctccccattagcatctcagcttttagaaatggacattttgtgaacctccccattgcattgcatctcagttgttgtatttgagatgctggaacgtggagatgcaatgcagtgaactcaacaatccaaaatagccaatccaaaattttggtgtctaaagagttaccatttccactataacagatcgccatcaaatttacttaatgtcaatatcacattatgtacactttaatttccaactcagaaaaaaaggtctagatctgtttgtggctttattaccaatgtcaccattatttttgagccattagtataaggagttcagatgtttgagttcctagagtattaaataagagagaatttagacaaccttaattttttttctttttttttcttttttaaccattgtcatgagacagactcaagttcaaatcccaactcagtcatttattgattgtgtggacttggccaagttgcttaacctctgcgtctcaatttcttaacttttaaaatggagataaaatctaccttgaaggattataaggaagaaaggttatttgtaggcagtacttggcatgcaaaagctataacttactaataataattattattttatttatttatttatttttcatatatattttttattatactttaagttctagggtacatgtgcacaatgttcaagtttgttacatatgtatacatgtgtcatgttggtgtgctgcacccattaacttgtcatttacattaggtgtatctcctaatgctatcccttccccctccctccaccccacaacgggcgctggtgtgtgatgttccccttcctgtgtccaagtgttctcattgttcagttcccacctatgagtgagaacatgcagtgtttggttttttgtccttgtgatattttgctgagaatgatggtttccagcttcatccatgtccctacaaaggacatgaactcatcatttttatggctgcatagtattccatggtgtatatgtgccacgttttcttaatccagtctatcattgttggacatttgggttggttccaagtctttgctattgtgagtagtgccgcaaataaacatacgtgtgcatgtgtctttatagcagcatgatttatattcctttgggtatatagccagtaatgggatggctgggtcaaatggtatttctagttctagatccctgcagaatcaccacactgacttccacaatggttgaactagttttcagtcccatcaacagtttaaagtgttcctatttctccacatcctctccagcacctgttgtttcctgactttttaatgatcgctattctaactggtgtgagatgatatctcattgtggttttgatttgcatttctctgatggccagtgatgatgagcattttttcatgtgtctgttggctgcataaatgtcttcttttgagaagtgtctgttcatatccttcacccactttttgatggagttgtttgtttttttcttgtaaatttgttggagttcattgtagattctggatattagccctttgtcagatgagtagattgcaaaaattttctcccattctgtaggttgcctgttcactctgatggtagtttgttttgctgtgcagaagctcttgagtttaattagatcccatttgtcaattttggcttttgttgccattgcttttggtgttttagacatgaagtccttggccatacctatgtcctgaatggtattacctgggttttcttctagggtttttatggttttaggtctaacatttaagtctttaatccatcttgaattaatttttgcataaggtgtaaggaagggatctagtttcagctttctacatatggctagccagttttcccaggaccatttgttaaatagggaatcctttccccatttcttgttttttgtcaggtttgtcaaagatcagagagttgtagatgtgtggtattatttctgagggctgtgttctgttccattggtctgtgtctctgttttggtaccagtaccatgctgttttggttactgtagccttgtagtatagtttgaagtcaggtagcctgatgcctcctgctttgttcttttggcttaggattgacttggcgatgcggactcttttttggttccatatgaactttaaagtagttttttccaattctgtgaagaaagtcattggtagcttgatggggatggcattgaatttataaattaccttgggcagtatggccattttcacaattttattcttcctatccatgagcatggaatattcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcttgagactttgctgaagttgcttatcagcttaatgagattttgggctgagacgatggggttttctagatatacaatgatgtcatctgcaaacagggacaattagacttcctcttttcctaattgaatgccctttatttccttctcctgcctgattgccctggccagaacctccaacactatgttgaataggagtggtgagagagggcatccctgtcttgtgcccgttttcaaagggaatgcttccagtttttgcccattcagtatgatattggctgtgggtttgtcataaatagctcttattattttgagataagtcccatcaatacctaatttattgagagtttttagtatgaaggactgttgaattttgtcaaaggccttttctgcatctattgagataatcatgtggtgtttgtctttggttctgtttatatgctggattatgtctattgatttgcatatgttgaaccagccttgcatcccagggatgaagcccagttgatcatggtggatacgctttttgatgtgctcctggattcggtttgccagtattttattgaggatttttgcatcaatgttcatcagggatattggtctaaaattctctttttttttgttgtgtctctgccaggctttggacaaccttaatttcttattatgctcactacttcttgtggctgagccaaaacactcatgctacaagactaaatcagtttctggagtttagaagtctttagtgctttcttctactttattgaattagttcttcattgagagagagagagcatatctaggaggagccagcctgtcttggattgtagtgatattttgaatggttcctttacttgtttttgaaagctcataaacccctgttaagtagactaggtgtccagaccttcatccttgatgctggctcaggcccatctgtggagattgacatggctttaacttcatgatgaagttaatttcatcttttaacttcatgatgaagttaatttcatcatttaacttcatgagctatagacccatcatagatccatcgatccagttttccttccaggccccacattaactgtgccaagaccagaaaacacagagacttggcctagacttttttcttggatactcctttcttgtgagattgccactggagctcagcatcttggcctctccctatgagatacagtgggggtgaatgaggagggtaaaccggctgaggatgcaaaaaagagaatgactcactagctgtgcatcttagcaaggcatggaacttctagcacgtggctgctggcaaaagctcaaataactgtatatctgaacaaagaaaccatattcaggactgctaaatcccagcaacttaaggctctgccaggcaaagcaagagaaagaaaggggaaggatttgagaaggggttaattgagggtgaggtaaagaagttttactctgttatcatgttgaccaatttgtatccatttgcctttctcctttgagtcattgtcatttcagttgctgagaagtggactgaaaccttgctgttagatgaggaaataaccctgccaattatacacacacacacacacaaacacacacacacacacattccccacactggcatgccactgcctttttcaagataggaggaatcccttaactagttatttcatcatgcatgaaaaaccccaaagtaaaaatgttggagaattaacaaaaaaaaaaaagttacagccgccaagccaatgttgcattattttctcaaaaactcatgatgtcatggacttagctcacctttagtgcagccatgcgaataatgtgtactgagctttctatcatgtaccattataattagctctgtcaggtcttagccctgcaaccctcatgcagataatatgataatatgtcttcataaccaagtgaccttacatgcacaatatttctccccttatgaagattgcatgtcaataaagtaattgagtctcagaggctgcagcgagggaagatttaggtgattggacgtggagagcagtgatgtatgatgattattattcctcttgtcagggaggcgcgtacaagcgaggatggccagaagatgacagggatgacgggttgcgtttcattaaaaaaaaaattgctgttaatcaccactctattcttttcaaagtcactgaggaaagaaactcttttttcattgtagctacaatgaacatccccaaatgggagcacatcgtaagatttttagcctcagtcccctttcacagtgtctttcttctgttgcaaagaggctaaattaagattttaattaatagatcagccatgggggcctgggcaggggccacccagcttccctgctgtagggctccttgggtttccaaatgcagaaaaggcgcctgccgagatggaattgcacttcctctcctctctgcgttgagagaagtgtgctggtgagctctataaaaagaaagcaaatgtgagagaaccagatccgagacaactatttttacttgaattaatttgtttggacagttttaacacttggaacatttatatttccatactttataaaagcaaacatgctgtttctctagctgtaaatttatcttatgatatcataacagctggaaacttgtagcctggtaggattttgtttcatatttaaacagcttgagaaatatgtcggaaacaaggtatattttcccccatctctgtgtgttttctcctctcgtattaggctaccttaggagtgtcggcagtatcattcagaagatactgaggctccaggatttttattagcctggcattgttaattgctgctcccttgcaaacctcttcctataaatgctgagaacacactggagccccttccagaggagttcaagaatcttttcaaggggaaagaaagctaacagtaaaagcatcttttgttggcagaggggcttctgaagtctttaaatctttgttcataagtaattgactaagatctaacagccttgaaggaaaggagctgatggtatcactttttagtcatagtattaaccttgtgatttatggtacaaaattagccactgcatcctctcattacgggtgctgagtgatttctccaggcaggcaggagggaattgagagctggatttttgtctcctggagctctactgtttcctcctagggaaccacagtgagtgtttttagggataggaatattgttttccttccattttctctgctctgtaaaagaaaatatcaaatgtaagtaaataaataacctaagggagctagaatgttcagaggaaatgttaacccaagggtggtccaagggtggcagtatagaatatagagtttcagatagggtcagtgagtgatttcaacctcctaattgtcccacaaccccctcctctgcctccacaaattcaaggccaaagctttctgagtattttttccattgaatagtatctggagtagagattatatccatttctccatctggatagttttttcctaatgaattaaaaaccacctaatagacttcagggacactaggaagactctgatgatttcaagaattcataatccttattctatgctgacattgaaattttacaagtggagctttatctctacagttcaaggctttggtttctggtgaaaaatatgtctctccctgggaggaagaagcagattaacctattatcagttatttacatctgggtggaaaaaaaagatctaaatattttctgaatgctttaagtagagaacaagcaagataataactaggtgcttggggagtgaatttacgtgtttgaggcgggctgatgcagagaggagcatggatgcgaacgggcccataactaggagctttttgctgttgaaaagcaactttgctgactgcacagtttgtgtgagccctcctacagctcagttctctcctcacatcagcctgcttccctgggtgacgacagtgttaaaagcacagacttcagagttagactgcataagttcaaatcacttctctactacttgcaaattctggggcttgagaaagtcactagtctcctgtatgtagctcagttttctcatttttaaaagtgacaataatggtgccttgctctagggcagttataaatgtaacatcctcataataaccaataataagagtataatcagtgctgcctgttgttattatcccagtggatgataacttagacctatgctggattcgttgtcattggtgatggtggtggtgctgtggatgataaagagatgatagatcctgatatggtttggttgtgtccccacctaattctcaacttgaattcccacatgttgtgggaggaacctggtgggaggtaattgaataatgggggtggtctcccgtgctgttcacatgatagcgaataagtttcacaagattttatggctttaaaaaacgggaatttccctgtacaagctcccttctcttgtctgctgccatgtgagacatgcctttcaccttctgccatgattgtgaggcctccccagccacgtgaaactgtaagtccaataaacctctttattttgtaaattgtccagtctcaggtatgtctttatcagcagtgtgaaaatggactaatacagatcctaaatatagcaagtgtactggtgcttaatttccctttgtaaaacttgagtcctggctgattatctccaaactttcccttgacttctttccctgtattttagttccagtgtgtataaaagtgaaagctgaactttctgaaatgtcgtgggtgtgggcctgggggtgctgctggtgtggtgctcctttactggctctgtcttgccatagatctccacagagccctgagctgtagggctgttgatgacaaaaagagaacataaaatgctagaggaaagatcattctaacacggtgcaaatccccaaaccttccctacaatttctctgtctcccatgcctcacccaaagcaacatttggcctagaagggaactttgagatgatctggccccatgcctttcacactgagctatgcggaattctagcattccaatgagacttgtcagaggtgcagggggaacaagtggtgacccatcagggtggagctaacagggctcccaaagctggcttccaaatccatttttatccattcaatacactggggtctaaaggaaaatatcatttaatgaaaaaattttattgtctaatgtaacaacagaaggttcaagcatcagtgatctagtccatcttgttcattttacagatgaggcgcagaataggcttatcactggctcatgtcactgccagttagtcatggaccctagccttgaaattgctctttggaaaccccactgtttccagtattgtgtctgcatagtggcttccacgggccgagggctcacctcattgccccctccccacatgccctagctggtctcttgaatgactatagcactagcatgtggtggccatgtgtgccaccagtgccaccaccctaatggcagctgtgattatcagcacagaggcccaggaagaaggacagaatggactgctggcggatgaattgggaggggagggaatgggcagaagtggagccacattgaactcagaagtataagtgaagaacccactataatgttgcatggggccttgttcagcaaaggaagattgctgtctcccagtccagtgcagctgaattaagtgatctggccagggtggcagtggggcctgtgttccttctcacaggtatctgtgttaatgggcacccctgcctggagccgccagtgtagctgcttggatttcttattcttttatttccatcctgtctccttgttttctgtcactgtgtcatgtcaaatcattgtcaggtggcagacaccacaccccccaagtacaaaggtatcaggtttcaggacacaggctgaaatgaatataataatgggagccagaacgaggcacagaccacttagcaggcaaggaaacagctaataagtgttgttagtggtttccatggggaggacctggcgtgcatttcttggacaggcaggtggagcacggcctgtcctggggtccagctacagacaggcttgtgcgattagtattgatgcctgtcactttgtggctgccaagctgttgattctgtgaaagaccaaagactctggttatctggtaatcaacactgctctcaggaacgcactggggaaacagaaataggctttcctgagtattgactgaagccatggatcatgttgctggtttgtgttttcctctagccccagccctgagattgctccagcctgttcttcacctgcagtgccaggtaaccattcttatttgtcatgggatcaaattctaaccctcttagagtgagcccatccaaatgctctgactcagctgaacactgatgtaaccagggtgacttgggcgacagcataggaaataagaatgcatttgcatgtcaaggtggaaattcagtctctcacctttgacaaattcccacacctttgacaaattcccaaatccaaatgcatggttgacgcttaggcttcttcttatcccactccacctcacctttgcttttttaaaggctctttaaaaatataaacattaaaatccaaaagggttagtaacagaagaataaaaaatataattcgttttctctcctaattcattttcttggtaactgttgccttctcatatcctcttctttctttcttttttgtattcaagaactttaatatcttatttttccaaaacatcaatgtcctgattatagtgaaccttgaacagacatctcctcctgcccatggaaaatgagttctgacttttcttgggttttgttaagttttaatctctttttttctctctctctttcttatttactctctctctctctctttaattttcttcctttctctcccctcctatctcttcactccctctttctctcccctttttctcccactccccttcccaaagctaaaaaatgctgaaacatgattgcttctttctttcttatgtaaggagcaatgggaactgaggttacacagaatgtgtcacaaactggatatcaccacttagctaacccataaatccacccacttacctacccacccatcagttcatccatccatgagtaccttaggccatccactcatccatctgtccatccatccattcattcatccatccatccaataagtgccactgagcatttaccattggccaggctctggcaagatgctcaggatacaacaataaatgagctttccatcttcaaagagctcaccatctagaaaaataaaaccagtgctggatggtaagtgatctgtgataaatggtatggatatatgtatgtgtgtgtgaatgtgtatacctacctgtacacgcacacactgccacccaaccattaagtgtctgcttggcttttgagttgtattcatttgtagattaatcaaacaactcttcattaatgccagtagccaggcactgtgttaggagttgggtttacagaggtaattaagatacagacccttcttattcttaagtttctcatgaaacacagcctggattatccttccctcccaccctgccacgtttctgccccataaactagaccattctctggtaatctacttagttttttagataaactaagaataatctatatgacatagtccttcccagtacttaaggaagggaaagtatcattgaatatatcacttgcaaaggagcttagagattatcggcccaagcacatctctttgtgaatgagaacactgaggctctggaggagatgaagtgacttctccaggccacacaggaaggcattggcagaactataacttggccttgccaagatgtggcctttcagtccttcccaatgttctcaccccaagtttctctttcatgaggccccagaagctgcttagattcagacaggccactagaggctgatgcagtcatctgaggccatggcatgttacctctcagagcagaagggagaggcttccctctgtggaggggactgagaaggctacccatgactctgaatcaagagtggttttataagtcaagcactttgtcttcctgctcttcagagaagctaaaacaagaaataaccaaaaggagacaatgtctgggtcagcaactgattacatttttgatgtcacactgccttctgggttgggagaagttgaaagacttcatagaatcacccccgctcatcttattcttggtgaatactcttcacacaaatgtcccaagtgccatgctcatagaggggttggtgcttgggtcatcagtaccttaggccatagcagttctcagaagacattatccagaagcaaaaagccattatctagaagcaaagttcaggaatgaagattcggtctctcataggtcctgctaacacttatctttctggcaaaggataatgataaaaagaccgaacagatgacaaaaagaaagcctacattccagatggattgtgagggttagggagaaactgggctgaagcaaaatgctttaatttttgggatattggttatttccccagtttttactttaaatctgttgctccagaaataaaaggacacgctaggctttagttatatgaaaacatgatattggttctgtatgctgagaggagccagaggtgggttgagagcccagctctgtggtgatgggccttggaaccatgtctctgatgttctcatgtgagaagcagatgagtagaggttggtggcagagttagtgaaatagaggctggctcccgcttcccacagtgctcagggacaaatgtggagtatattaataaatgcagagtcattaatgctttctgtgagtgaaaaataagtgtgtgaagaaaagactccattgtcattggactgtaaatggtgaaagggtggaaaatgaaaccaggcttgtgttgccctcctaggatggctgtgatgacccaggccacttggggttccacatgagccctgtggaatgtgggctgggccacctgcaggtcaggctgttcatgctgttgccctcaccttctctacgggtttcaaagtgaacccttgtgcagggaggtgtggcactccctgtgcctttgcttctcaagctgctgagtgacagtgacaagatgctggctttggagcaggcactacaggttcctatgcggagagcatcggtgctcagggaagggaaatccacccctgtgctcttcacacccagacagatgctcacaggttccagggatatacagggacatttctaaatctgtcttggacgtccattcactttatctttagccatggaatgctgacaagtattcagtacggttgagtgaccttctataggtcagagcaggctgtgttctgattgagtttagaaaactcataactctggccaagccttcaattggtcaggtggatggggctttgttaggggagactgcagccagagccagtgtcgcccaccttccttctccctccacctacctgagctgccagtcccttcccactcctcaaacaggacttctctggtttgtgaacacattttctcctcttggtgtgcagagcttttggttccagccctgtcagatagtgatggcacagacccagtggtcttttaatcatagcaatgggctcattgctttgaacttgcatagtctaaaaaaataaataaataaaacaggaccagcaagaacagctggaagaaatagaaggaacttgagtttaaaaagttggacacagcgatggatccaggctcagctggtctcattcctctgcctgaacagcttagcagaccagataacaaagaatccttttgcagctgtttttcttcaagttagagaattttagagccacaaaggaaactggagattatctttatagatgaagaatctgatgtccaaagaaattttccaaggttaaagagatatctgttgccagagccaagataagagcacagcttcttccaacaccttaattttattgttttgttttgattgttttcctttcagttagccccctaggaaatgtttattgaggacctactgtgctcaaagttctgggcaggcttctctgggtaaatcctgaattcaggtgtgtacatctggtgaggaaaacagtaaacaagagtaaaataagacagtcaggcaagagaagacaatgcccagaatccagtgacattcacaccaaggcttaaagtgcaacagaaaatgtgacagcagaggaaccaggaaaacctttccggaaggagccctgggaagagcagaatgggtgcattcaccacctctcctcacctactttgggatgctcatttgattgaatttgtaacaaacaaggcctttgggtcagtcctgcttcttccaccaacctaagggatgatggtcattgctaaagcttcctctgagccagtccttcgccaagtggctttacctgtttattttatttggtcctcataacaaccataaggtaggttgtatcactgattttcagatgaggaaactgaagagcagggaagctagtgacttatcgcaagtcactcacctagtcagcggcaactctctgttattgatggggcttcacttacccttagtgtgaaacagaagtgtccttgagatcacatatgcccaaagacattatcaaaacacagacgtgtggtgatgcaggaagcctgagaacccttggcatctgtgcttttcacatgtagaaggaagaatctcattgcttggacatgaggggatataagcagcgggtcagggcccagcatcacactgaatagagctccaggaggctcacaggaccctcatcagaggctctctgtgtgttttatggttgattgagctttatgaccccaaagaatccgttatttgttttctttatagcaggcctcaaacactgggctttggttattctttaaacttacaatactcattgcatgacagaattatttttcatttctctctttctttcagagccttggaatcccattaggaaatttctagtacaagcatttgtgggagatactagtactcgggttgggcatctgggagagatagacaagctcttattacagcatggaggatggggagattacctggccaagtatcatttcaggttgtggcagaaagagattagctccaatttatcaccgctcacattttcctcttttcccccgttttctgagtgtcatggaaatgatatttgtgaatcccaggggcctctcacagtggtgtcagtttagagatcttcccagatacatctaaatgtggacataaaatgtaatgggaagaaattgaaaaaatatctgtttctcgattctttattactgtggagttaagaaagctatttctcatgccgtttcataaatttgaatccaaatgtatatgttaatgtgtattcagatggcttttggatgattcaaacatgcagactcttttttttaataaagtttgtcaaatttctggcaatttagagatacatgtttagacaatgtatatgtgcatacctgccatatgtacatacactgtgttgtcaaaattgagcctaagtgaactatgatgaaaatttaaaataagtaagcttatgatgaatacttagtagttgaactcagtatttgatttgtaaaatataaacatgagtgaaattaatttttggctgcttagtccattaatattttacctaaattaaatttgaatctaacaaagacaaacatacacatttctctccaggtctattattatctctgtgacacaaaagcacagagggagagttcagactctaaaagaaatgcagtagcaagccccaaagagaatttttttaaatttcagggaaggttttatgagacaggaaagctcaaagacatatctgtgacatttaaatgtctaccatcagcttgtttcctaatattgccattagttttgctaattagggccaattacttaatgcttgcctgggttgtggttgggttgagggtgcatggtggttcatgcacaatctgttcttctgattcaaaaacaccattctctccttgcactgcttgatccttagcagggaaagcgcccagttagaagatgtgcctaaactaacacaaaggaaaggtgttgtctctgaagtttagaaagaattcagtgagctcctaacctcactcaagtgagtttgaaccacaggaccaagctggctgagtgatctcaggattagacaagaagatcaggagtgctccttgatcctcactgctggctgcaggctctcaaagtgccactgcgcctgcacccagtgcttctgagaggtgccagcagggatggatggtaacagtggtagtcccctgtgctaaatgcaggcgtatgggtggggaatatcttttggggtttccctctaaatagtgtcatatctgaaatctcagaaacagaagaacagtcagcatcatgtcttctgaaccaatgctgatcaggaaggttctttacggcagagttttcgaactgtagggtatagaacgaccccttggggaagtctttaaaaatcttacccatcactcaccagaagttctgattcccaaggttgggagtaaagtgtaggagctcacctcactcttggttgcatctcatgagctacattcctcaagcttaagtaactgacactgtacatagatcgttaagttaaagatacaagagcgattaagaatccagcataatctgtaagtcagtgataccaagggtatgggaggcaatgagggcaaagagagtggtgcagtctgggaaggcctctggaaaggtttggaacttgagcaaagctcattggccatgtaagatttagataatatcaggcaatagtgaatgggatgagtcctatcatttgtggacaaattgactaaacaatcacaatgcacataatttcaaatggccaaataaataatcttcatagtcatggttcagggtgggtaaaatattgagggtattacttctcaccccaaaatggcctccatttccctaataccccatctagacctgaaataaggtcagccctcttttagtttcgctgagttcagtagaactgtctgtaactagctttgcaactgatcttgtacaaggcaattaacttcacttagtctgatcttccctcgtttgtataatgggagggttgtggtggatgatttcagatccctttcactctagcattccatttgacccagttaaatgcttctcattattacatgactggaaataggccaggtcaaatgatgccccttcaagcagaaccatcagatccggctgtacacggtaaagatggatattagactgctcaacttatcatcattagtcccgtagtctcataatgggaatgcactatagttcatatctgtcatagttagtatttggaagactcaaagctggtgagattattcacatatttattcctgtgtaccgcatatgccaccccacgtctccccttcatcatgtgtctatgacaatatattgaacagaaaatctccatcagctgactctgacagagtgtattatttacagtggtgtcaaaatgtgctgcttataattgactgggctcataataaaccaacctaagaatcttttcttctcatattccttcttactggtaaatcttccgcttgcattccttccttccatcaacaccttcttcattatttacagaggagggaacacacaccagatggtgcatgagtgatattgtagggtgactctttcatcttgggaaggcctctctctcttctctctctttctctctgacttaagattttgctgtggtaattaagggtgagagaaatcaagtcaattggacttagtttctaaagcaaacagaatacacttctccatttctctgagcttcaggagacaatgtggggtgacactaatagttgcatgggcaatttcattttttatcctcatgttttcacttactatctgtgaaacctcgagaaaattactgaccttctatgtgccacggttatgtcatctgtaaaatggggatactgatagtatctaacccataggaatgttgggactgttaaacaagtaatgcacataaagggctaaacccaaactaagaacaacaacaaatacacctaggccaaggcacacataaagtacggtcattcatgttccccattcatcaatagagagccccctaaaatgttcctgtaccagaatgtgtttggaattgcacagggggagtggcagcctttccagcccccatccagcaggatgtggatgtgcgaggctctgcccccctctcctctccccagctgtgtacctcctcttgttcttctttcaaagactcattacacttggcatacacatgagattcttacctagcctgaggaagatttccaatttttattttgtggctccaataatcataggtattaagtatgactgcctctcctaggctaacctgcaaaagccagaggctgggtttctgtggcaccgtgctcactgaagcagtattttcctagtcatagcagccacctcccatctgccacctcgtctctctgcctggaatatccagaaacactttggtgtattattcccacatttaaatggacaaagtttgctcatagaaagtactaattttgatgagcatttctttttaatttaattgctctgatgaaaaccctcataatcatgtaattcttaaagattagtgtaaggttattgccctgaaaatatgtctagtttggcacacagggtaaatacgtgattattgctaacccttggttttacgcaagaaaattatcattatccatcaaagcaaaaatgtttagtagaatgaagtaactgacggaaaaaatgcctgaacatggggtcctgtgactgagattgatggaacacttatcatgtggctttaatcccagacatttgcatattttctcacaaccttgcttctcctctcagaggtttaggttcttagcttaaaatgagaaggtaaaactaaatcataggccagatgtggtggcttacacctataatcctagcgctttgggaggcttaggcagaagactgcttgagcccaggagttcgagaccagcctgggcacatagtgagaccctgtctctacaaataaaacataaaaaattatctgggcatggtgacatgtgcctgtggtcccagctactcaggaggctggggttagaagattgcttgagtggggaggtgaaggctgcagtgagctgtgaacacaccactgcactgggtggagtcacagagtgagaccctatctcaaaaacccccataaaaaccaatacataaatcatatgtatagtcaagtattttatcttaaaaatcagttgatttctctttttaggcgtgcatagaaatatttgtttgctgagcttctgcgacaagtcttacgtaatgaataaactctggtgttcagttgtcttctaatatagaacattttaatttctgagggaagatgcaatcattcttccatttgtgtgatttctttatttggatggacataagtgaagatttactccacctaggtctcaaaaaattgttcaattttacggtatacaaaaacataatagtggactaatcttatttaactgatgaggaaactgaggcaaaaacacggccaaggatgaattagctatggagtcaggaataggattggggtgccttcattcctagcacagtgtttcttcacctgtacctcctagaatcatgaaagccataaggtacctggtacctgaacttagatcaaacagctttaagacaaacagatgtgtacagtttcaaatgcaaaacccaacatgaacatatttgtttggtttaagggggctttctattttgcattctcttgcaaatgctgttttccaaaatgcttaccgttcaagttgggtaatagccatccttccattgactgatcatccactaccggctcttgactctggcatcacatcttcgagataatccgagctagagtttggctgtcatctagaattcacagttttagtttagcactttgctgactagtactttgcggattagataatggtagttagctttctgagactctgggatggcaagcacatgggccatgatatttgtagtagctagtgttatattgagaaaaactaaggggtctcaccagatgaaaccatctttaatatcactttgctagctatcaatacagcatagtgtagagtttaaagtgctttatccacatttacatttcaaccacagccttgttccctctagacatggtaggtgagatttttcatatgcctatcaccaccagctatatagatttgtaacttaccatgggttgtaaggttatattttggcatttcagaagctgtcctcattggatgccagaatatttgaaatcttttggaataaacaagtaattggttctgtgagagcttatgagttaaaattaacttaatattacccttctgggtttatattggtttcttctcctgatttttattttattaagcacctttctaagtcctggtaaggttgggtgtatggacaaggaaaccttctacttggatgaaagaaagccccatggaaggctgagtggatgagcgccgactcaccttggtatttaacatgactacagaatggataggtcttcacttctcaggcctctgcttcccattccacaaaaccaaagctttgttcagctattccctgggtggggtgtttgcctttcctctgagaaaatatgctggcattatagaaaagggagttgaggggtgcggttttcctctggcatagatcactttcatctaatctgaacctcatagaaagcctctgctgattcagaggacaatgactttgacctatttatttcaaggacccacccaggctcagcccagcaaaggagtacacagtgcttgctcagaacacagctgaaagaggaggtggtgttcaatgggaatcacaaaggctatggtagaagtgagtaatgagagctgggctcgagccctggtctgagttcagtgtggatgtttaaaggcgaccattcttaagaggcaagagaattcgatactgggttcaaatctcaattttattttaaaagtgcatcagtaacttgtagctcatttgatggcctgcagcccagcttgtttagaaatcccttctattctctctggtactccaagtcccaaagaatctgttctgatggtgtggttacacaaccagccaagcacagccttaggttgctctcaactcagaactcaccctatcacacgttgacgaatgcaagagcctgttagagacactggaacccaagatggtgagtaatactaaacaaaggccaaactctctaaaatgcttaggccaggaagaaggacaatggggaaaaaaagtttggatcagtatgtatatgtgtgtgtgtatctgtatgtgtactatatgtgtgtgcatagtgtatacatatgtgcatatatttgtaatatgtaaaaattatatctataattgtattcatgtacatatatacatatatgttcatgtgtacatatatatgtatatttatatccatatatatttatattcatatgtgtatataggtattcccatcgtatgtgcatgtatagtgtgcctatgaaggacaaagcgcggtgcaaagcactgtggggaatacttggtagattaagacacaggtcttcctctcaaggatctagagggcatgtagttattaaaagctgttaactatcccaggaatgcctacccttctccatgatttggtagctgatataggataatttgcccctggattttgtgaataataaagaacagaaggctggtatcacaacacttgctgtggtcagtttctctcctctctcctgaaaggcagtaatcacattttctagttgtactgcctgcttttagaaaaggtctctgctgctatccaaccagcacagtccctctttgcttcagggtcttggcaagagcaggttctgattctgaagcattaacattcttcagggctctgactcccctcagaggtctgtttgcttctgaccctgcagatgcagggcatcacggatgtttatttgtctgttacctaaactcaggacacatgcacagcagtaaattcttcatttgccagagttaatcacagccatgctatagcttatatcattcccactgcccattgggaaagccttgaaaatatagatgggatttgttctccagcaaataagttcaacaaaccagattggtgagactacacagagggagaggtttgagttggagtccctccttgggtaatatcttattccattcctgccaaggatcaaatttaagacttgctgcattccaaaaaaatagactagtgacaacttggagtggagggaaacaagaaaaggttctgtttgtttgctttttcattaaacatttttaaaaattaagaagtaatggagaaaaatataatgttactcatgttttcccaattcaactgaatatgaaaaagtgctaacattttgtcatatggacttcagatcatttttattattaagaaataaaatatttagaaataactgaagtccctcacattcctctccctagtcccagcttccccaaagcaaatattgtcatgcatttggtgtgtagctagtccttttatccttttattgcgtagatctgtatacagctataaatagtatacggcattgttttagtacttttaaaaattattatcacagtgttatactataccttttaacaatgtgtttttattttatcaacattgcgtttttcagaattatctgtgttgaggtatatacattgtgttcactcattttaactgctatacagtactccatcatataaatttgatgcagcttatttattcattcctacacagatgatcatttccaaatttttgctattgtgagcaaagctgcaatgcacacccatatatagtcaaccctccatatccatggtttttcatctgtggatttaactgtggattgaaaatatttgaaaaataattgtgtctgtactgaacatgaaacagacttattttcttgtcattattccctaataatgagttctacagatatcttctatgtcaagattgctaatcatgctgctttttcttctaaatttaattttttcttaatattttgtaaccatgtttatgtgtttctcataaaggtgttttattaatgaagttaagctagtaactagtacttccaaaatctagtaggttaacacaacaaaaatcttgtacaaagtgagctatgtaattgtgtgattcctgcagtccacttggtgactcacagatccaggttttcatctcaagaaaaagcaggttggagctgccacgttgcgtggaaaacttacacccacttacttatgctttggctgggaagtggcacatgttaattccactcagagccctttgggcagacctgccttgtatttctaggtgcagagtggtctttatttattatgctcagctgagttggtgtgtgcctttagtgtgagaatttagagttttccttagttatggaaaagttctctattgttagctgtttaaattgcttctcagtagtcctgctgtggcctaaattctggaaattgtgttcggtatatgttggagactccatactacttgatttctttcttttttttttttaacctcattatgtctcagtgctgcactcagaattatttcctcactactgccttccagttcactagtgttctctttaaccatggaaactcttgcgttaatttcatttatagagtttggagatttcaattatattatttctgtcttctagtttctatattgattattttgttagtcatttttctcattttatatctattagtttacatagtgctttcttattcaaaaggatattatcttttactttaagtattttttaaggtttttcagagacaattatgtgcacttttttctgtagtcaaattttcctctgattgttgagttctgtggatatcttcttggttctgtttttccttattggttttgaattttaggttgcttgctcatctagagtgaaaattatctttaaaaataaacctttaaatatccatcatgttttgcagattttcagtagtttccatgtggctccctgagaatctcaggccagaaacaacttctatgttagtggactaggattcctgtctcatagtggtattggggatattgcagatccagtacttagcagcttgtcacatatctggtctgtgtgacttgctctgttcattcctgtctcacatgtacatggtgatatagttcacagccttaatttttctcattttacccattcaggttggagaccctacgagttttatgctgtgagtcaggcttgtgtccctaaatcagtgttcagtgacagccttctctttgcctttgtctgtttctaacctagagttcaacaaccccatggttccagcattttttccttgatgtctgtttcagtacttttccagtgtataagagatattcatcttgtattgggtatagatacaacttctaatttttgaaatttcagctagaattgctttttgtggtgtagcaaggaaaatgtattgaatgtttaagtttacaatgttatcttgactagaaatcttttacatttattttaaagagtttattttgatagtaaaagaatagatgttcattaacatcttgaaaagcatatagaaaatatttaaataaccaaaaatataactgcataaaataattacagttaacatgtcagtgtgttgtcatctatattttgcttttcactgaatagaattcacactatatatttcgttttatatccttctcttttataccagccattatagggtggatttaccatgccataaaataatcttcaaaagcaatttttttaacagccccttaatgtcccaacatatggaggtactataaaaacataaatcatccaaattttaatatctctcttagcataaattaacaagtaattacttagtaaaagagtatgaatatttgtaaggcacttgatacataatgaaacattttgatccaaatacgctatttccaatttacattccaatggtagcgtaatcattctctagccagtactaggtattttctctccaattttaccagtaggatagatgaaaagtgccgtctgttgacatgttagtgctctgaaatattccgatatctcttttgatattatttcttaaattctaattctttagctgtatttttttctaaatgagactctagattcctctccttttctggttttcccagagaacctgttttaatattttccatttttcatgatttttgcttacatgcattttttcttctttagccttttgttgtgcaagcattcttattttatgactctttaggctgattgtttaattaattaattttagtaatctcctgtcaattcacaggcttacatgctttgttaacttctgagtctatattctgtaagtcttgatatgaatttgcttattttcatttatttccaaagtaggtatagcagatgtttatttactttgtgatctaatgtttattgaggaaatccccagatttatttcatcttttaacttagatttctgacattataattttattaaattgaagtttgagaatacagtttttttctttcaagaactttatcaaatatactaaatgaattgacaaattttaaaatgcctcaggggtatttgaaaagaacttacattttctttttgaagggtataaggaaatatatgtatatatatgagtttatgtatttatttataattatgttattcaaagatttcattccttttaatatttgtttaatctggctgacaattgtataatatttttcagctcttcacttctggtagtttttgctaaatagattttggtgtttgatgaatatattatatgtgtcataagttatatgtcctttatatcttcattgcagaggattccttttctcagcacaaaatattatcttcttttcccagatattgctttctgacttatatattgttgctatcattgttttttgcaagactttctcgtatactattgtttcaataaaaccatcttttacattttatttaaatatttttggtgagctgtatgtacttgattttgtaacacctattaggaaaacttaaggcattcatatctgttgctatagcatatatttgggcttaattttataactttgtttaatgctttcttgctttttcctttttattctgggttttgtctgttttcatcttatgtagaggtttggaagatcaaaatattttcattaattgtactagtgataatccttttgtttataaactatatactaaatcctatattcctctgtcaaattcaagtaccagtttctaatgagaaatgtaaattatctggacttttcctgactttctacttctctgtatttatcagtgtttattccttttacctggtgttatgctatcaacattttatgataaaatcctgatttttaaaaatatatgacttttccagactttgaatttaattttgtgcccatgttacaacagttcttcatatgttttcctaaaaagttaattgatttcaaagttccttgccattttctttatagtttagctattgcagtcttgatttcacagtcttgagttcttgatttctctttttctttattagttgacagacattcatttttcgtgtgctttctcaggaagagaataaaaatgattaatgtttttatgattttaagcttagtaaaatgtcttcctgcaacctttttacatgaacaacttggacataaacctcttaagttatagacttttctagtcattgctctggacaaatcgtttcattgtcttctgacatttatttgattttgcaaagaagggtgaggccagccttatttttgctactttagagataagctctcattcctcttttcatttttgtaggattttaaatttatcattgagatttaaaacacaatagaacttccctaatatttctagtcactaaaaaagttcatttcatttggttctcactaagccattttatttaaagccttataagcatataaaacttataaagtctttctctggggcaatttctattttattaattcttttgtgataaattttctgttccttcctcagtaacacttcatctggatctaaattgtcctccacgtctgtcatcttctcttctatatttttcctcggaatattgagaaatattctttaaattttcttccacattattattttacattgtttcagttttacttctgtttatattgcctcaaatatggactttcattttaccattggattttgggtttcctaggttaatttcttaattcggccagtttactaattatctcttcattcatctcagaataatttttcctttgacactctgattctcttttacagagtctgttttacagagtttttgaggatagcaaacagatgagttctaaatcttgcttttgtctcatgtaaaaataaaatttcaaatatatcctcctcatctgagtcaacatggaagagctcctattctagatgatattgttgtctttttttgtagaatccatagtggcagatgtatacatatgtttttctatgctcatttttgaatagggattgttgtgctctaagaccaacaagcaggttctgtggcatgttccttgcttctatgtcactctaatttggtaggattctactcttgaagtttgaagtgatgtacttaatttgggatgtctaggaagcattcttctgtgtgtttctgatttgcatttttttttttttgagacagagtctcgctctatcgcccaggctggagtgcagtggtgtgatctcggctcactgcaagctctgcctcccaggttcatgccattctcctgcctaagcctcccaagtagctgggactacaggtgcctgccaccatgcctggctaatttttttgttatattttcagtacagacggggtttcaccgtgtttgccaggatgggcttgatctcctgacctcgtgatccgcccgcctcggcctcccaaagtgctgggattacaggcgtgagccactgcacccggcctctgatttgcatttttatagacttttattgacagctggatattttgagcaagctagggagccagatatacttttccattttcctttgaacggtgctgcatgtgaagactatgttcttcaggaagtgcttctccaatgcttttttttttttttttttgtggaggagggtggtggacagagtttcaatcttgttgccctggctggagtgcaatggtgtgctcttgtctcaacacaacctccacctcttgggtacaagtgattctcctgcctcagcctcccgagtagctgggattacaggcatgtgccaccacacccagcaaattttgtatttttagttgagatggggtttctccatgttggtcaggctggtctcgatctcccgacctcaggtgatctgcccacctcggcctcccaaaatgctgggattacaggcgtgagccaccatgcctggcccgatgctttgtctttacccatttataattattttcttcaaaggaatgacctatccctaaaatcttcctgtattttcttcattgcttgattgaggaagtatgaagagaattctagccctctatggctctgaggtcacttatcagatggctcatcagtgtggacaggaagtgggtggcatcttgacatgctttaagtcaactagattgtgtatgcctatgtcctatgctcttattttgcttcttcaaatacacctaagtgtgagggagcattcaatttggatgtagacaataatatatggtaagaagctctgggatctgggtcagggcctcaaggtccatctgattgcagcagggatgtgggaaggccatgtggggtccagaacacttaactctcttttaaatgaaacacctaatcactcacctgtttctgctgccctcagaattttagaaaatcactgaaatggaatgaaattaaaacttacctactccaactcctttaacaggcagatggtgtgaaatttaagatgggaactgaatgaaaaaaaaaaagatatccatcaggtaaagatgagaacagaggatgcagatggctagaaagctggtacaaagatgtgaagtagagggtctaaaagaaagccaggaatagttgacgtatagtgggctagcaagaaaatggaaagcagtgtccaggaagaagatatttttatgttggggtaaggagtttggatttaattaaagtgttattggaaggccctgggggaggatggtttaaaaagttaagtaacctaatatgatcagttaacagcaaaatgtttatgtatttgttttattcactcatacacttgtatattctttcattcaataagtaaactcatatttatcaaataaccactacatgtgatggagttatatcctaggattccaaattcctagtataaggggtatttctattatgccatgcaacttctctactggacagtaaactttgtgtgaacagggtctggacttctatatatttgaatctcctaagacttcaacagtcataggagtacctgacttatggtagcccctaaataaatatacttgatagatgaatgataagtaatattctataatgttcacagaggtctctgaaatagaagaatatttctaaagcacagttaaagatagtcatcattagcagtgaccaggattccctgcagggcacagttccataaagctcttgtaaggactgatcagtgggttggatccattgactcttttaatcaggctaaatatgctgtcccttctatgcatatatttgctgggattctgccatgccagtactagtttggccatgttgatatgaaagagtaaggatttgtctatttagttgccaactaaggtgtaatgaaatctcatggcaaagtgtatatgaattcaaataggagccaagcccttcacctctactgtgggttatatgacatacagagtcttcttgaaacatgtattcccaagactttcaacagtgcaacatctgttttactttgagggggctatgataagcatctgcttagaggaatgatctgaacaaaaccagggcacatttgtttgccatgctatagattatctagtcttacattgttaatgaataaatcatgcaggatggataaaccggtaaccacaacagcatgtttcatactgcatttaagacattaatttatgcattcatatatttttcctgtagacactaaaaaatttatgttttaaatagaagatcacatggattttgatgtagctcagcagttggatgtagattccagaaattcctttattaaattagagcccagttggctgattagggttctaatgttcataattgtaccatttgatgcattaagataagtgagccaaagataaaaatatagtgttttatgagaacataaaatgcatatctatgtacatattccatgtttgtatgagacattacatttaatcctcaaaactcatttcaaagttcatgtcgtgaacgtttacaaaagttcaggaacctcttaaagtcacataggcaattagtagcagagtctgaactgagaatcacatcttctcaggcataatctagttttcctggcttaccacgacaaccgtttcattgataagttattttgaaatcacatttgggggccatcactcacatgtagtatgaagctaaatctagaacaacattcattttgaattctttggtctggtacacataaatagttcttaggatgaatcacatagatggaggagaaagatagacaaaacgttgatctttgggtgattgcattgaggattctaatctctactgacgtgctaaatgttggaattgaactaaaaagagtcactaatcatattacttccatagtgaaagtagcagtgtctgcattgtatgctcttttgttgtttaatgcagactccctaaaaaggcagattttggtcactccgaggctgcattattctttgtaccaacttggctatcctaaaacgagcaaaacaagcaagcagagaatcgagacatagtaaataaacattcttaaaacccacatgttcctttaaacataaagaaaaaaaatgacccagtgagaattggaggtgatttgggtctgcattcgctcagctagaccaagctgttctcaccgccaccccccaccccgcccgactttgacttcctttttatttgtatcttccatttcctttccctgggccagatgtgtggattcccctgttgtgcccaatgacagagtagacttttctggaaactgccaggactatttgtaatctcctgactttacagaggtctcatatgctgagaaggacaaattctgatgtttcacagcaacaggaagagggttagggatgttgagagaaggacaatttgggtggagttttcacatatgtttctctttgatggagaatccagggcagggatctggtttgactggggccaagttgtatttctgctctctttattccatgtgacttgagagagcaaccacatgagtacagagttttagtttggagcatgacttcctcatcctagaatgccagagtcggagaggccattaaaggtcatgttgtccaacttcccataaaattaattttagatgaagtctgcaggagagagtaagagagcctctgtttatagaagaaattgtctcctagaatctaaaactgtctgttgcccattggatcaacatctatggccacccagaattggtgaatattatagaaagaaagtgtgggatggtgttaaaggacattagttcaactcgtcacccaacgcccaaatcccttgattagaaatggaaaatataagatatattgatggtattgaattggtatgaaattctgaaggttttaaaatgctgtttatccccaagaccaaaataagtgaatcctaggctcggctggtcacctcttcctgcaaggtcctgaggtaagagtatgcatcgatgctaatccctgatgggatgagactttgatattagccagggcctttaggaatacaccccagtaaaaacactgatgggctaggatgaatgtcacaggaggctccttaccttagtcagcttagggtaacttaagggtctatgctagaacaaaagcaggccaaaaggtctgttctccttgtggtcacctctaaactcaaattcaagttgcaaatcttatcacttctctgggagacaaggccttacacaccggttagcagcagatgaaagcataaaaattagagtttgtggcccattgtctggcatagatgtgtaggggaagtggcaggggatcagagggtatatgacaagggcaagtgttatcttctgggaccatcctacttagttatgtgggagaggagaaagcccctgaataatggaagggaatgtcccaagggatatatcctgttgttactctggctgtgtggcagagtcgggtagtaaggaatctagaagggccacatcaacttgtataggcccagtgattccaactgtatgcaccacagtgaagaaaaggtattctatgctggccaaccctgctagtatttctcctcttcctccttaggggctgggttgttgggcttgggaaagggtatgaatatccctcagagaacatccccttgcatagcatctctacccgaaaatagtcgttcggtctccattttgttcctggtgtcatctaaaataaggaacaacaaatagccagattcaatttcagcattatggtttgagcaagggcctggcttctagagtggggtgtgttgagatggttttcccactatttttatttaactcaccaaatatattctgtaattgggcatgacccagcaaaatgttccactctgaagttttatcatggaggccaaagagcatgttcaatgtctgccaagttctcaaaggaaatagtagtgggagggcaggccctgagctggagcttccctggtgactacaaaagcaattgcagaggaccacgtgatgtggctccagagcacatgactcagatgtccattgaaaagctgtatttgctcagggtgatggctaagaaaaatgtcttatgccctttaagaaaagagtcttgttttgaagtgagataatccttccattttcataaggtagttactgaaaataagtgttcattttctttgtgcagaccaaggagtaggccttctgagaaagttgcactcttattaaaaaaaaaaaaaaaaaggcactatttcagatgaaagcctgagatgcagatttgagatcttaaaacttgaagtaaaagtcagcactctgatgtgcccagcctgtcctttctaccttcccgttgttaagaggtgttcttttctagctcttgaaggaagactttcattcttaccatgtcacctccttcttcccttcttttttattttttggggtctgaaatagtaatcctgcaacacagaacttgtttggaattctgactgttttaatccttgccttaatttactgaggttaagttgaagataggaagttgagtgttggttttttcaaattgtggtcttagccgtaactccgactttgaacattttcggcagttccatggatgtctgcggatggtcagagtcacatttcattgtctccaagaactgtcatgaccctgtctttagcattccttcaggcttctctttactacagatcaagaaagtacttggcaacagtctcccattaggagagagcattcagggttttagtttcaacttttcgaagtttaatgcttttccattttcttttctccgcgtcagccatgggacaagtaacgtatagttgatcttcagtattccctgattctgtgtttgcaaatttgcctgcccactaaaatctgtagcccccaaatcaatattcatgacacactttctcagtcattcatagtcatgcacaaagcagtgaaatgttgagttgcccgatgtgcatgtttccagctgaggttgaacaaggtgacactgctttttcgttgcagctctcagactgtatgcaaatgtctttccaatggtctatttagtgctatgcttttcatgtgtttgtgttttttttggtgattttgcagtttaaagtggctgccaagtattgtgctgaagttctgtatggtattcctaagcccaagaaggccatgatgtgccctgtagagaaaatccatgtgttagataagctttcttcaggcataagttatagtgctatgggccataagttcgacattaatgaatcaacaaaatatcttaaataagtttccttaaacagaaatatagaaacaacaaggttacgtctcaatcagttgacagaaatgttgtgaccagaggctttcaggaacctaactctgtatcttccttaggagcaatcgttcagtatttgctaattcagtgtttgcagagactttatagggtgtagctgctgcaaatgacaagaatcaactgtaatcatttactaagtatcagctgtaatggtgaagataaatattctagacttaatatgccaggagggatgtgcgtgcctcatatgctctatggacatgttacagtaagggaaataggaggtgtccccctcaacctggaactcctctaacaagccagatagaaatgcatcattttttaggccatttcacttggatcgaagcttgttttctttcacactcctagtgctttcaaaaaaaaaaaaaacttggctgtttaattaaaaaaaatttggcctgttttgtatatatttgcagtctgagcacccatagaggggagtcacccctctcctccagacaagggtgggttgttgaattttatgtgaaatcttgacattgcaataaatctctgaacctgaaccagcctgcactggatatttaatactgttttcatttccaatactaatcaatcctggaagaatgtgctgttattttttagttacatgtaaacatttagatgaatataaaatggcttattgatagcttacatgcaggcaagtttattgatacttttgtcaaattctgtttgattgattgatttggccatcgtactgctatggatatggaatagaaccaatatgacatttttatttcctggcagtggtacctgagggtgaatgggatatggggaagcttgagctctgtctcttggatgagagcactatcagagcctgatcagtggagctcctttctttaaggaatgacctcaactctgtttcacatcagacacagtttggaagaccccacaggccattgcactgttgtatcattcatgtgggaagcccagcttcacaggggccacagaaatctcctctatgtgacacttctggctacagtgcattattttgttttattctgattttttaaggaggtccctagtaggcatcttaggaaactttgaaaatatattaagaagattcggcatttgatgcacagatacaaataaggccattttcctcagcctgcaagcccagtctgagactttgcaacctttctctcttctgattgtgaattccaagtgtcaagacaaaatagcactaagaaatcagtaaaatgtgacggtttttctcaagcgtctactaagagcctagccagatgcacatttcttattccttttggtaaatagattcagatttggtatgattcaatgaactaaaaaatatcccctgctcaaagcttgtctatgcctgctaattgcatgaagcttaacagatcctccacacacggcaccaaataagggctggctggaaatcaaaacctccttgccaagcactttggattttccaaaggaactgtaatgttcctggagatgtttattaatggaaatggggaactttgtggaccagggtgaagtcccagagattgatagcctgttactagtgtttattatttttgactgcaggttttgaaagcttttcctcctatcctccctaaaaggaactttctccgtcacttgggactgaaaatgggggtggagttcaacacctcatggagcaatccaaaatagacgcacagaatgttaataagcccaggattttgccctctgttttgtattgctctgccccaaaatacaaaacctaattagtgcatccagagaagcgttaaatggatttcatgctgtttaataaatgctttacgtgctttggtgccactgcgaaatgtgtggttgagtgagggtgggaatagggagaggaaatggttgctgtaaatgcttcctaccaatgtcaagcactataggatgagcatcagagatgcgtgtttataactcaggtgcttcatgttttcacccgaattttcctccttttggctagcctgttattttccttttgggcttttgtttttttaattttattattattatactttaagttttggggtacaacgtgcaggtttgttaatatgtatacatgtgctcccagacatcgtctccaaaggctcaacccacaattgtctacactcagaacaatgagaaattgtgagtgacagatgtgcactgagtgctcactgggtgatgagccctgaatgggacatgggaattagaaggtgtggccattgcctctggagagcttatgtccctatggggaagatagaacacataatatcctattttcaagatagaccgtcagtctggtgttcaaagcctttcataatgtgtcccctatttagtgactggcctgtgacatctctcctagaggctggtctttattgtcttatatgttggtcagtggttgtgagacttcgctgcacagtagaactgtcaggagagctttgaaaaagccccagtgttcacactgcaccctctatcagtgctttgagatctttaacctgcatcaggatcacccagaggatatgtggaaacacacatttctgggcttcacacccagcatttctaagtcagcaggtagagggctctaaaaatttgtatttctagaagttattgctaatgctgctagtccaaaatcacacttgaggaggattggccttcatcaattaaatcagaattgctgtgtgtctgatgattccagcatgcagccaagatggagatctgtgttccacacattctttaatgcatgtggtggagacagatgatcacatatcgtgaatgcctctgattattttccatgatttagctatttttctctgactagacagtaaaagtcgtaatagcaagaactgtgtatctttaccttttcttgattctctcagggtgcccagcccagggtggtcacacagaagtgtaacttgaatagtgttaaccaaggaaacgtagaagggtggatgggaagcattgcagataccaccagcactcttcatttccctactctccaaaacctctaaggaaagttctttccctctatttgtggactctaagatgcattgcagagctactttctctctcctcttccctccataggggagggtgcattttcagcatttacttttaaagaaagcaactgcaaagagtactgtattcatagataaaaactgcattcacatcctggctctgatgtttcttcttatatgatcttggtgacactacttaacattttcaagtccccatttattcataaataaaatacgtataagaacatctctttcacagacttctggaaattaaacgagtttgtgcttaaaacacttctaaggacaatataaaacacaaaaggcacagtaggccttttgtttataaccacattgtagcaaacacacatttttcctggaaacataatgggagtgctcttgggttatgggaagtagcaaggggagatgagcaaatatttgtgcctcatcctgacctcgccatgcatggtgtgaaatgtctaggtatgccatcaagaaccaaagtcctgtgtaacagaaaatctccagtgagcctgtcatgatgatggagacaagcctctgttgaacttcactgccagtgaactctactaaaatgtcagtcctgtattcgcatagcctatcagtcagggagcaggctatgagcactgagatttccacagcaacctgttggtgcctttagtgcattgcttccagaatgattcccatgaaataaagagatctagcattgtacttactggttcttagcaaatgttcttccccgtaggtagagtgccttaactctagaaccataaatttgttttcagaatgcaacaagattgcatagttgtgtaataaagctcctgacagagtgttaaagataggagggggagatggtgaactgggagagccaggaatcctcatcaaactattatgggaggctctgccctctgagaagagaagtgctgtcttaagaaatttccttgatactcaaagggtgttttacacagaatcacctgggcttttgttaagaatgtggactcaggccgggtacaggggcacacacctataattccagaactttgggaggccgaggcgggcaggtcctttgagtccaggagtccaaggctagcctgggcaacatagagaaaccccatctctacgaaaaatacaaaaatcagccaggtgtgatggcatgcacctgtagtcccagctacttggtgtggcttgaactcccttgaaccagggaggtcaaggctgcagtgaactgcaattgtgccagagtgaggaccacagagggaactctgtctcaaaaaaaaaaaaaaaaaccacacacacacacacaaaaacaacaacaaccaaaaaaaccagaatgtgaacaacaaccaccaaaaaaaccagaatgtgaactcaaacactcagacaataccctagaccttctgaatcagaatctgcattttttttttcaggagtcccaggcaatttgtatacacttaaatgtttgaggagaaagatagaagagtctcttagaactagactgggaattaagacacctgacttggtattcttttagttccatcttcacctcagtttctccatatgaaaaaaacagataagtagaataagttccttcccatcagttgacaggaattggtagtaaaagaatccccatagaaaagatttagaagtctaaggtccagaagaaccatcctcttcctcttcacccagctcctttttgttaacattcttcgatgcccaatctcacttccagctgctttggggtttggccgctatagctagatgtctcagcagcttccaattcccattatgagaagttgaaattctcccataggtacacagttcttctggcatcccgcaccatctttgcctgtgctgagtggtgtgtggtctggccttcaagggagccgtttccagcagtacatgtgaggagaggacctgtctcttggctgctaggaagcactccagccagacaacagccctctccagctactcagtgcctcccacattggacaactgggaaagcacacagggaacagtgggggttgttgagctcagcgagtgtttcctatagtgcataattaaagaaaacacctgtgtagctgctaaatcacttcccgctgttcccctgtgcaaatgctgtgctcaataaccttacaagtgcctcattccttctacccaaccgaggcagtgcacagagccacaatgcataaagctggcaagttattagttcagggccccttaaaagatctcttaggattgatttgttactagtccatggggtcccttggttagtctggtggcattttgctagactgcagcttcagggaggctcagggatgggtagtgggcctactttctccaaactgcccttctttgatcagcacttctctgtatccaaggcagtcccgtggaagagctctagagctgcaggagccagaaaaccttaaaccacaacttcaatactgtaattgtgggccagatgcttccccaggggaaaacagccaacaacagtgaaatgagatgcaagtgggacctatggattttgtttgaaattcaggaaagggaagtgacaataaatcaaaaggaaaagctatcattctaaacagacctcttcctgctgctgaagtttatggggtgctttggttaccactaggatcttgtggggcactggctgcccaaagtgaagaagatagactcccttgtagcagcaggtggattggcaacaggattcagtgtgatgacaggctagctttgtaatttacttcttccagggcaaagcaacatggctttcactgcaagttttagagtgtttgagcagatgagtgaatgtgcctaagagacccagtgaagaggattgctggatgttgggcggtggcaggggaggggggaagggctttaaagaaacagaactgaggagaaaggacagctgcagattcactcagtctcttctgcttcactgctttgttctcttcatagccttggtcataactgaaattatcttgtctatgagtttgtccgcttgtgtattatgtatctccccaaataggatgtgaacgctgcaagagctagactcttatctaacttgtgcagagctggatcttcaaaactagtcagtccagtgcctggcacacagtaggtgcaaaataaatttttttttttttttttgtgagatggagtctttctgtgtcacccaggctggcatgcattggcgtgatctcggttcactgcacatcatccacctcccggttcaagcgattatcatgcctcagcctcctgagtagctgggattacaggcacgaaccaccacgcccagctaattttgtatttttagtagagacagggtttctccatgttgatcagggtggtctcaaactcccctcctcaggtcatccgcccgcctcggcctcccaaagtgctgggattacaggtgtaagccgctgcgcccggcagatattctgaatcttgaaggaggaataggaattgactctgggctaagctggcagagaagggtattcccggaagagagatgaggattatgatgcatagaggcaagagaacctggtgtgttgggaactgcaattgtaaggtatgagtggacgagtggcgagagactagaatggcctggtacccagtcaacatgcctacaacagacggggctgggaaaagagctcctaggtgaggacaatttctcagacatgagaatggccagggcagttaggtgaactctagtacagatgtacacactggacaatttaactaagaacaattcatgtgtctttacaaagggttatctttccagctgttacttcctctcttccagctcatctgttggccaccttgttgtttacccctttgagtaaaaataagcaaaaagccagaagaatggggtaacctcaaatacctccttaattttgttttttgagcagctgcttaaaatgtctgaaacattttttgagttagaaatctgaaacaaaacaaggcttccaaatgattcatgagtttccattattcaagtttccctcatatcttcatcaccgtgtaggtaatgggtgtgaatctctgtgtgctcatatacatatgcttgattatatgatcatctcgtggaggacatgtgacacgggaagacaatagggcacatgatatgctctttgatctaaggtaagagtagcttctctctcctccctgtttcactatggctttatggacatgtgggcacacagaagaagcagaccgcactgcagaggctgtgcttatagacataactgcttctcaaggccacagataagaggatggacaggattgaggtaagtctatattttggcagacaagaactcttggtggcctctccattcagtgctagaatgttcctactatcacaccacttagttgatgtttgtgatttcaagtgctcaagtggtcagctcctctgataccactcctatgacactaaggggtcaccaggaatatttgtggccatgggcatatgagctccaagaaataaaagattcattaagggctgccatagagattttctggttcttttgtgacttgagctgaaattgtaagacctgtgtgtgtcatttcctttctgtaagtactctagtcctcccaggagcagcctcctgctccactgcctttggagctatcactactgccataagaaccaaggacagtagctatttgttcccgagacacttggtgcactatccacagtgacccatagcaataaagttaatttcaatacaactacctatgaaaaaggaaagtgaaggatgtgtctaaaacaaccctggaaccccatctttgaggatctgttttgtacgaccactcctggacactagcgtatgagttatttttctgagataatttaagagaattgtttaagtagggtatgagatttctagggcttccataagaaatgccactcgctgggtgacttaaacaacagacatttattttctcccagttcgggaggctggaagcctaagatcaagatgttggtggggttgatttcctccgagaaccatgaggggaggagttgtttgtggcctctcccctccccttgtaggtggctgtcttctccctgtgtcttcacatggtcttccctctgtgcctgtctgtgccccaatcttttcttacaaggacaccagttatatgggattagggcccaccccaatgacctcattttaacttaattctttatatacactatctccaatcatcagtcactttctgaggttctgggggtttagaacttcaacctgtgaatttttggtggggcacagttcagcctgtaacaaacagatataggaggactgaaaaggcaaggcaagggggaaacattgaaataacaaacatagtaattgcaagaagcaactaccataaccttaggactagaggaataaaaggaagaggctggagtcatgagaacttagcagcttggagaaggagtcttacaggactggtgcccagaactctgaggggcagagggtatgagcagctggtactggcaagtatgaggggtagacaaacagacagatgccgggagcatgggataaatggagaggagcgtttcctttctctcccctttcatcttcagatcttgcttttgtgcccctcgtaggcaggacctaacaggtgtccgctggcaaaaaagaagtgtaatctgcagcctacagcatgacaggccatgttattgaaggatggatttttactaagacacaataactttaataaccaacacaggctgggcgtggtggctcacacctgtaatcctagcactttgagaggctgacgtaggtggattgtttgagaccaggagtttgagaccagcctgggcaacatggtaaaacccctactctacaaaaaggacaaaagttatccgggcatggtggtgtgtgcctgtagtcccagctactcacaaggcagaggcaagagaattgagcctgggagttcgagactgcagtgagctatgatcacaccactgcactccagcctgggtgacagagtgaaaccctgtctcaaagaaaagaaaagaaaaaagaaaataagcagcacagattccttcagcttcttttaaaaagtcgtatcttgctctgcagccttgcttttattacttagcagcacatacgaaaaagtctccagtgtccatcctcttccagcacatgaattctaatggctgcagagtatattccatcataaggatgtatcatcacttacttaaccaacttcctattcttagccattcggtgttttaaaattttgccactcttataaataggactgcaactcaataaatctaagcacacatccttaagtaatcccttaggattaatttttgaagtggaattactaaatcaaaaagtatgaggatttttcaggataaaaactcacttttctcagctatggaaaacgtgaattaagtgtggcttcttctgtcctgtagtacagtagggtgagattacaatgtactagaacatggggttgaggcaaggatttaaatactattggccgaaactgagtaataggatgtaatgatttcagagtgaaactaggcctactctttatgaaagcatttaaaggtgaggggacagttaacagtagcatctgccccagctggtggaaacgccatgttgttactgattttaatgcagttgcattcttagcagaactaattttgtaaagcatttctctaaataatccaattttacttggtgcttatggttggacaaaggagcaggcaggttttgtatcagtatttatggagtgtagccttgtaggaattactctggccagaggacattgctataaatctataatgatggttgtgtttttgattccatctttagtttctgaatttcagcctttgtaattaaaaatccatatcataaaattttggcctgtgacaattttatttttctcctgggatgctatgatttttctgaggcatgccttgctcggtccttcatggaggctaaaggtctgggggattttgagctgggtgtttggagcccatcctcatgacagatatttggcatgccagcttgggtgctacccttggaagatccgagtccaagcttttactggctccctgaggacaattctgagaaagttactatcccttgtactggtttctggtgctgggtatatacttgcttttgtaagactaaataaattgataaattcagctgattcagagcgtttacataatctttccaatgtcaacagtcatttaaattatcctaactttatactgaatctccaaaatccaattactagctaataataattgtcagttttactttaaacctttaatgataggtcacaagggaagtgtagcagcaggattaaatcgctgtagactgtagctatgcccagtcttaaattactcgcctcttatctctggctaacagagccactatatgttttgtcaccatttttgctaaatagaatatatgtcaccaaaattaatttcatctcccttaaattagcttcttagtgtgatttctcacttcagtcaaaatttatttcttcaggaatttaatttccttcttcatctcttttattcgagagagcaagactgttctggaacaaatgtcgtttaatcactggctggcaagttttgaggcttgcttttcattaataattgctgacccctttagggggagtgttggaggatatttctgttttatttaagctattgtatgcttttaaacagagtagactgggctctttctgaatagtcttagagaagctgtaaaccttgcatagaacaggaaagatgaatttaccacaaagaaaacatttttttcacatgagggatgattcagcagggagtttgtaattaggcactttagttgtttttcctactttttaatcattttcaggtatacacatctgacaatagctatcctttaagtaaggcatgtgtttggaaaaaactgtagggatttaaaagttaaacttctcacagaacacataaatacacagaagacttgcccaactctgaaatgcatcctgaagatacgatagtagcacctgtaacaaattccctttgctcatcaacagaaacctcaaggcactaaaacattaagaggcatggagagggagaagagagaggaagtgagaaagagagggaaagagagggagagggaaagatccatttctagaaaggcaaagtgcgaggagctctgtgacctgctccccagtgaagcaaatgtaactggtgaagataatgaaaaaatatccaaccattcggagtctctggatattgtactaggagaatacagcaaatgaagaaacagttatttaagagcaactactaaaactcaaaaggaacaatgggattctgtggcacttaaaccatgacctgttcctttcctcctccccgcagcttactttgaaggaagctctctattacaggtaggtgtggctaagaaggtggggctcccttgcccctcatctcccaatcaagggatatggcatcttacccagaagagcaggctgccaacatttcttattccctccgactctgagatgcagaagttaagttcctggtgaggtcagccaagaagtcagagactactgttctctgcccactccccccaactcaaatgtggcagttctaccacaggtgaagctaactgagaacacttgggccctcatcattcttgctcaagaatgatggggtggagggtccacactgggagaggcaagctgagaagactggagagtgtcatatctgcctcagtctctggagcagtggcttggaggtttttctcagtgggagagcagtccataaatacatagagctctgaagctctgaagctctccttaggggaactgtctttgaaacagagtgagggaagttcaaggctaagggtactttcttccataatgaagattttggtggtaattaagaggagactaataactccatgagagcaaaaacttacaccagaggcaagcaagtttactagagagaaccatggaaacagatagctaagaactctcctgggttcacaaaaaacctaaaggactagcctcaaaaacttcccctacccatgtacaattcagtggcatctataacattcacagtattgtgcaatcatcaccactatctctttccaaaacactgtcatcatcccaagaagaaactctagaatgattaaaccaacaacttcccatcccttctcccctatgatcatggattaacaattagctttcattagaaacaatggagaccagaaaccaataggatggcataatcaaagtgctggaaaaaaaataaaaaaactatcaagcaacaatcttatatccagcaaaactctctttcaaatatgaaggtgaaataaagacatttctaagtaaacaaaaactgagaagctttatttgctagcagacttcctttacaagaaatactaagggaagtaatacaggctgaaagcagtacaccccagacattaattcaaaaccacacgaataaacaaaaagcaccagtaaaggtaattatataataataaaaagatagtataaatacatattctcctttctgcccttaactaatttaaaaagcaattgtacgtaagcatggaattaccatataatctagcattttttacttctaggtatacaccccaaagaactgaaaacaagaactcaaacagatacttgtacacctatgttcatagcagccttattcacatggacaaaaggtagaaacaacccaaatgtccatcaagggattaatggataaaaaatgttggatatacgtacaatgtaatagtattcagccataaaaaggaatgatgtactgatatataatacaatatagttgggaaaagattattctaagtgaaataagctagactcaaaaggataaatattataggaatccacttaattgaggtatctaaaataggcaaatacatagagacagaaagcagaatagaatagaggttaacaaggactggtagcagaagggaagagtgaggacttgccagggagagaagagtaggcagttatagtttaataggtacagaattgcttttgggaaaataaaaatattctggaaatgtatactggtaatggttacacaaaattttaaatgtacctaacaccactgaattatgcacaataatgacaaaaatggtaaattttgttatgcacgttaaccacaataaaaataattaactctaaaaaagcaattatataaaataatatgtatgtaattatattattgggcttatatgtaaatgtaatatatttgacagtaacagcacaatggagatgggtgggaggaaacctgtattggtgtaaggaaatggcgccagatggtaacccaaatctataggaacaaatgaaaagaatcagaaatgataaatagaaagggaaatataacaagctctatgaatatatgcttactctcttctattctcttagcttctttaatagacataaaattatataaataataaaatgtattggtaggtttgtaatatatttaaatataatgtgtataacaatattagcacaaaaggaggaagatggaacagagctatataggtgcaattttaaaattttttgtgaaattaagttagcatatatctgaaagagattctgatgagttaaccactaataaaatctaataaaataactcaaaatatagcgaaaaattattaaagaaattatattacactagaaatattcacttaaagcaaaaggaagcagtaaagaaggaacagggaagcaaacacacatggggcatataggaaacaactgaaatggaatatgtaaatcctatataaataataatatcaaatataaatggattaagcaactgaatcaatagtcagagattttcagaatggataaaaaaacaaaatccaactataggttgtttataaaacacacactttagattcaaagatacagatagtttgaaagtaaaagaattgaaaagatgtatcatgcaaacaacaacaataagaaaattggagtggctatacgaatagcagaaaaaaatagactttaagacagaaaaagttactagagtaaaagaggacattttgtgatgataaaagtgtcaatttgtcaggtatgtaaaacaatcataaacatatagacatggctacatagccacagagccccaaaatacacgaaggaaaaactgacagaccagaagggaaaaataagctttcaacaataatagttgtagtgttcaataccccactcttaataacagatagaacaactagacaaaatatcaaggaaatagaagacttggacaacactataaaccaacttgacctaccagacatctgtagaccttccacccagcaacatcagaatgcacactcttctcaagaacatggaatagtctctaggatagaccatatattaggccataaaacaagcctcaataaatttaactgggtaaatcatgcagagtgtgttctctgataacaatagagtgaaaataaaaattaataaatttggggaattctcaaatatgtagaatataacacattgctgaattgccattagtcaaagaagaagcaataaagaaagttgaaaaacactttgagatgaatgaaaaagacacacaacataccaaaagttacagggtgcagctaaagctaaagtaaacagagggaaatttgtggttgtaaatgctactacaaactgagaaaagagttatctattcaataacttgattttccaccttaagacagtagaaaaacaagagaaaactaaactcaaagaagatagaaaccataaagagcagaagttaatgaaataaagaataaaaagcaatgaaaaaattaataaacccaaaagtttttctttaaaaggatcaacaaaaatgccaagtagttagctagattgaccaagaagactcaaatgattaaaatcaggaatgaaagagggagcattactatcaacctgacagaaataaaggattgtaaggcagtactatgatcaattaaatgccaatgaattagataacttggatgaaatggacaaatttctaaagacagactcaagaagaaatagaacatttgaatggacctatagaaagttaattgattgagtttgtaaacaaacaaacaaaaaacaaccgtctacaaaaaaagaccccgggcccagaatttacttcactggtaaattctatcaagcatttaaagaaagtaaatgttaattcttcacaaagtcttcccaaaatagagaagggaatacttcccaatttattctctgagcccaccatcattctgattcctaaaccagaaaaaggcatcataagaaagaaaaatatgatatttcgtgaaatgaaaaatccttaacaaattattagcacatcccatctagcaatgtgtacaaatattacacacaatgaccaagtaggatttatttcggtaatgcaagattaatttaacattacaaaaccaattaacataatacaccatatcagaagaataaaggacaaaaaccacatgactatctccacaccattaaaaaaaaagtatttgacaaaagtccacatccacacacattcatggtaaaaacattcaacaaactaggaaaagaaagcttccccaacgcgataaaggacatctgtgaaaaactcttggttaccatcgtacttaatgggaaaagattgaatgttttcccccctatgatcaggaacaagaccaagaaatccactatctccacttttatttaacattacagttaaagtgttagcccagaaattagacaagaaaacaaaatcaactggatgcagattggaaagaaagaagtaatagtatttacttgcagatcttgtatacaggaaattctaaggattctgctaaaaaaaaaaagaaaaaagaaaaactgctaaaacaaataaatgagttcagtaatgttgcagaatacaagaccaatgtagaaacatccatcgtaattgtgaaattaagaaaacaattccatttataatagcatcaaaagagtaaaagacttagaaataaacccaacaaaagaagtacaaaatctatgccctgaagaacaacaaaaacattcctgaaatacaatgaaaataacctaaataaatagaaatacatcctatgttcctggatgtaaagacaacagtactccacccacatttgatctacaggttcaacacaattgactctctagccccaatttcaaaacttattaaaagctacaataatcaagacagtgtggtactggcattggaatacacacatagatcaaaggaatagaactaggagtccagaaaaaagtcattgcatttacagtgaattgatttttgctgagagtacaaagataattcactgggggaaagcatagtaatttcaacaaatggcgctcaggtaactggatagtcacttgcaatagaatgcattaggaacctcgtgccatatacacctcacaccatctacaaagttaacttaatatattagtaaatcaaagccctaatatcaccactaaaagcataaaactcttagaagaaaacatagacataaatctgtgtgactttgggttaaggcagcagtgtcttaaatatgatatcaaaatcacaagggacaaaagaaaaaataagtaaattggacttcctcaaaatttaaaacttgggtgcctcaaagaacatcatcaggagtgtgaaaagataacctctagaactggagaaatttttataagtcatatatctgataaggtatccaaaatatataaagaacacctataactcaataataaaaagtcaattattatctcattttaaaaatggtcaaaggaattgaatatatttgtctccaaagaagatatagaaatagccaataaacacaccaccagaggctcaacatcattagccattaggaaaatgcaaatcaaaatcacagaaatatcacttcacatccactagaatggctataatcaaaaaagataaataataacaagtgtagggtgtggagaactggaaccctcatacattgctgttgagactgtaaaatgatgaagctgctttggaaaacagcttggcagtttcttaaaaggttaaatattgagcaattccactcctaggtatatacccaggagaggcgaaaacatacatacacaaatgcaaacaaaatttggtcattaatatctatagcagcattattcataatagtcaaagagtggaaataatctaaatgttcatcaattgatgagtgcataaataaaatgcagtatattcttacagtagaatatttggcaattaaaagaaatgaagtactgatatatgctacaatgtgggtaaaccttgaaaacattatgctaagtaaaaaaacccagttaccaatgaacatatatagcttaaggtaaattcatagagaccaaaagaatagtggttgcttagggatgaggaggctagggaaaagagtcagacattactgatggtgggcatgggatttcttttgggattgatgaaaatgttttcagattgtggtgatgattgcacaattctgtgaatatgcataaagttttgaatatatattttaacgtagtaaattttacgctatgtttattatatctcaataaaacttttatttaagaaaagatgaatacaggagcacccagatttataaagcaagtccttagagacctacaaagagacttagactcccacacaataataatgcaagactttaacaccccactgttaacattggacagatcaatgagacagaaagttaacaaggatatccaggaattgaattcagctctgcaccaagcagacctaatagacatctacagaactctccaccccaaatcaacagaatatacattcttctcagcaccacaccacacttattccaaaattaaccacatagttggaagtaaagcactcctcagcaaatgtaaaagaacagaaattataacaacctgtctctcagaccacagtgcaatcaaactagaactcaggattaagaaactcactcaaaaccgctcaactacatggaaactgaacaacctgctcctgaatgactacttggtacataacgaaatgaaggcagaaataaagatgttctttgaaaccaacgagaacaaagacacaacataccagaatctctgggacacatgtcaagcagtgtgtagagggaaatttatagcactaaatgcccacaagagaaagcaggaaagatctaaaagtgacaccctaacatcacaattaaaagaagtagagaagcaagaggaaacacattcaaaagctagcagaaggcaagaaataactaagatcagagcagaactgaaggagatagagacacaaaaaacccttcaaaaaatcaatgaatccaggagctggttttttgaaaagatcaacaaaactgatagaccgctagcaagactaataaagaataaaagagagaagaatcaaatagacgcaataaaaaatgacaaaggggatatcaccaccgatcccacagaaatacaaactactatcagagaatactataaacacctctacgcaaataaactagaaaatctagaagaactggataaattcctcagcacatacacactcccaagactaaaccaggaagaagcaaaatcacttaatagaccaaaaacaggctctgaaattgaggcaataattaatagcttaccaaccaaaaaaagtccagaaccagacggattcacagccgaattctaccagagttacaaggaggagctggtaccattccttcagaaactattccaatcaatagaaaaagagggaatcctcactaactcattttatgaggccagcatcatcctgataccaaagcctggcagagacacaataaaaaaagagaattttagaccaatatccctgataagcatcgatgcaaaaatcctcaataaaatactagcaaactgaatccagcagcacatcaaaaaccttatccaccatgatcaagtgggcttcattcctgggatgcaaggctggttcaacatatgcaaatcaataaatgtaatccagcatataaacagaaccaaagacaaacaccacatgattatctcaatagatgcagaaaaggcctttgacaaaattcaacagcccttcatgctaaaaactctcaataaattagttattgatgggacgtatctcaaaataataagagctatttatgacaaacccacagccattatcatactgaatgggcaaaaactggaagcattccctttgaaaatgggcacaagacagggatgccctctctcaccactcctattcaacatagtgttggaagttctggccagggcaatcaggcaggataaataaataaagggcattcaattaggaaaagaggaagtctaattgtccctgtttgcagatgacatcattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccagcttacaagggatgtgaaggacctcttcaaggagaactacaaaccactgctcaacaaaataaaagaggagacaaacaaatggaagaatattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccgaaaaagagcccgcatcgccaaggcaatcctaagccgaaagaacaaagctggaggcatcacactacctgacttcaaactatactacaaggctacagtaaccaaaacagcatggtactggtaccaaagcagagatatagaccaatggaacagaacagagccctcagaaataataccacacatgtacaactctctgatctttgacaaacttgacaaaaacaagaaatggggaaaggattccctatttaacaaatggtgctgggaaaactggctagccatatgtagaaagctgaaactggatcctttccttacaccttatagaaaaattaaatcaagatggattaaagagttaaatgttagacctaaaaccataaaaaccctagaagaaaacctaggcaataccattgaggacataggcacgggcaaggacttcatgtctaaaacaccaaaagcaatggcaacaaaagccaaaattgagaaatgggatctaattaaactcaagagcttctgcacagcaaaagaaactaccatcagagtgaataggcaacctacagatgggaaaaaatttttgcaatctactcatctgacaaagggctaatatccagaatctacaatgaactccaacaaatttacaagaaaaaaacaaccccatcaaaaagtaggcgaaggatatgaacagacacttctcaaaagaagacatttatgcagccaacagacacgtgaaaaaatgctcatcttcactggccatcagagaaatgcaaatcaaaacccaatgagataccatctcacaccagttcgaatgtcgatcattaaaaagtcaggaaacaacaggtgctggagaggatgtggagaaataggaagagttttacactgttgatgggactgtaaactagttcaaccattgtggaagtcagtgtggcaattcctcagggatctagaactagaaatatcatttgacccagccatcccattactgggtatatacccaaaggattataaatgatgctgctataaagacacatgtacacgtatgtttattacagcactattcacaatagcaaagacttggaagcaacccaaatgtccaacaatgatagactggattaagaaaatgtggcacatatacaccatggaatactatgcagccataaaaaatgatgagttcatgtcctttgtagggacatggatgaagctggaaaccgtcattctcagcaaactatatcaaggagaaaaaaacaaacactgcatgttctcacttataggtgggaattgaacaatgagaacacttcgacacaggaaggggaacatcacacaccaaggcctgttgtggggtgtgggggaggggggagggatagcattaggagatatacctaatgtaaatgactagttaatgggtgcagcacaccaacatggcacatgtatacagatgtaacaaacctgcacgttgtacacatgtatcctagaacttaaagtataataaaaatatatatataaataaaaaaagatcacaaactaaatattgagcttataaaataaattagaatgaaaggtttcataataaaaaaagactaaaatagaagttggaaacattggatgcaatcctatatttgctttttcctaccaatatgactttggaaaattttcttatttgtggaccttagctttcttatcttatgataatgtttgcaccagcaaggtcttagaggaggtactaggcaatgtggggcaagggagagcgactttattagtggttacagtgaccaaagagggctcctctcacaaagccagcttcatggtgtgtaacctgtgcagtcacaccccacgccatgctcagaagggcccaggcttggtttaattctctgctgtatgttttgaacaagggttcctgcattttcattttggggggtcctatgaagaatgtaaccaattctgatcctactgatagtgagaaggggctagggagcctttaatgtcctgcagagcacagggcagccctgtgcagtgaataattgccctgtccaaaatgccctgatgagaaacaccaaatgctaagtcatggttgaactctgaagggctgcaatttttaactagcttactagaacctaatctgaaatgttcaagaatagtgtgtgtttttcaaaaaatttgctttgatttatttcatgtacctaaaaagagtatgacgggtcgaaggcgactgaacatttagttcctcattttttttcctgagactgataatataccctatatgagccttatatgctttgaccttgcttctcatccattaactgagctgttgaagtttagatgattatagccttaacttattttatttctggttattagatttgttaagaaattgccaactcagtaggctctgtggcaaaaacaattatgattcctggagaatctctgatgaataataacgttctaagctgagcattttacttacattatttcatttaattttcccatcaatcttttaggttgatcattattatcctaactttatagataaggaaactgagtctcagagggcttaagaaagattagatgaaaatgatgtgtcttcttttttgacttctcaactgctattagatgaaacctgaaatccgtgagtttctttcattccttgaattttcccccagatgtattaggcctcactggaagaattaatgttggaatctactgatatatgttactgttatatacttatactgtagtaagcccctaagttggtgatattttcatgttgcaccaaaatttattatctacttggttgagaatataatactgtacatgataaaaatatactgaattaggaagtgcaagatttaatcatttctgaagtcatagaatagtagagctggaagaaattttaaagcactcctgtgccaatccatacatttcacagatgttgaaactgaggttaagataggtttaatattttttctgtattcacataatagatgtatggctttagtgacaaagccaggaatataatttatgagttaaagtgaattattggctcatcactcttcccaaacatttccttgcctccctttggtcagttttatctagatgaaataaaacaaccaatttgatggtttgacagatttcttcttcaatggaaataacttgcatggagtttagatagtctgtggatttcctgtaatatgggagttgtaacattttggagcatgtttaactcaacatagaggtgtcctctttcaaaaggacttcaacttaggtttgactctatgaataacccagcgaaaaataatttcccagtaagttcgaagaataccttaaaggtaatcatatgtattgagaaacagtaagtcctgccattgggacagcgactcaatggtatgaataataggatgaaaaagaaattgaggcatttagggaggttagaagggatattctaatttatatttttggatcaatttagaattcagaagcacttatttgtagcttattgatattcactttttgggtccattaagatgtaaagatggtcaattttataaattaatgtggatcatgaggacttctagatttcctcctgctttctacaattctattaaatgatatttaaaccaaggagataaagcttacgtatattttctttattcaactgtagacttaaaagaaaataaaactcttcaagatacatctcagacccagtgtttgatttttagattgtagccttgatatgctcagccttctccttctcaggcctctgcaatgggcctgaaatgaccttttattggcctggttcctttgatgaatgaactcagcacatttttgacagagatgaaggctggcttttttaaggccttctttagggagatataaatctcttgctgctttggagctgcatactgtttataaaccaaacttcatgcttccaaaatgagaaaactttcctccttctagtcttgcagggtctcacaaggatcactgcgcatgtttatcagcatttaaaagaaatagctaattatggggagtggtctaactaattgggcaaaggtctcaggtatacatttagctcttattttttatctccaactttctttgtgcaataggaaaacagattaatgtttttctttcttaattcaacttacagaaaatgtagggtcagattaactcataagaccctgcatcccagttcataagtcctttccaataacaagcccttctctatactgggcttctctaatatttcctaaggtgctgaccatcagccatccttacttcttattgcattcatactccttgggtaatacattcatttcatgaccccaaacattatatacctcattgactcgcaaatgtgtatttcatgacctccatgtattgcttgatctgcaaactatgttttcaactgactgttagatgtttccacctagatttccttcaggaacctcccagttaaacagaaatcattatcattcttgtgtcaacaccacccgtctctgcctgtccaattttttctcttcatatattttccttcttggttcataacatgataatcttatccagtttgggcaattgaagtaacttagataaatcctcagctcttctctcttgccacccattttataggtcattaaatatgccttttgggcactttttattgaagtattaacatacatttataagtatttacaaattttaagtgtgcagttcattgaatgttcacaaagtgaacagacctgcaaccagtaactaaattattcgcacacttaaatcccccttttaccccactgtcttcattatctctgcccatcaggggtacttcttacttagcatttaataaaatagaatagttggcctgtttttgaacttaagataagtggaaccatactgtatgtattctttttgtctggatacttcgggccaaaattatgtttataaaattcatccatgttgttgcatgtagcagaactttgttcattctgattgtctagtatgtgctggatgaatatttcacagttcattgagtcattctactgttgatgatggacatttgatttgcttccagtttggggctatagtcatgttgcaatgagcattctcatacctgtcatttagttcacatatttatatatccctgctgagaaaacacaaggtcttgctgtgaatagaatgtgcatttgttcagcattagcagatgttgccagatagttttttaaagtggttgtaccagctcacattattcagttcaattcagcagttgttccatacagcatgttgttcaataccaattcagcagcatatgagaattttcggtttctccacatgctcactaatactgggtattatgagccttgctcatttttggcataatgttccatatgaagtggtagctcatcatatagttctcatttgcattttccctgttggctgatgaagttgaacactctttcatacatttcttgaccatttaaatttcctctattgtgaaatggattttcagtctttgttcattttttaaaattgaattatcttattatgtcctagtttcaagttctgcatcagattatgaattgcagtttttccttcccacattgtagtttgcatttttcattcccttaatggtgtattttgatgaacagaagttcttaattttaatgtagcacaatttatcattgctcccttaatgatgagtgtttttaattatctatttaagaaatattagctatgttttacaacatttaaaaactcatttgatggtagtatacagacaatgacactctgatgggtaaaaggcagaactctttgttactggcagctccaaatcagagaaggctgccaggcagggccccataggggatttcacccaagaccatggtaacaacaagctggagctacacggggcagcttatggtaagcaggatgtgtttagctaggtcttccaagcttctcacggattgcctaatctgaatgatctccggggctccagtgtatagggactatccttaattgtttcctacctggttctggggcaataggggcaggcgcacagtggccttagtgtgtgagatcaaaatagtagaaatagttgaagtgtggctttaatcagctgctcagaaaggaaaactgattgtcctctagccagggcttcaggactgggtcaagaaaccattaaaaaaaaaaaaaaagcaaatgtacagactaccataagaagcattgctttattttccatatttaggtctagagttaatctgaagttaacttttttatgtgaactgggtgcaagattcattattgtccacatggatagctacttgattcatcacaatttattggaaaaaagttccatttgcaaccatgatgcagctgtttatttacctctctttctactaataccatgccatagtaattactatagctttataactacagcatctgtagggatcttgatgtcttaacatctgctcatgttactctttcagctgctgttgtacatttgccgttttcattgtcatatgctcttcctccttcttttccctcatccccattccctttcccttcttcttcctcctctttctcccttttcttactttttcttgtcccatcctccttcttcttcctctcattctccttcttctctttctctttttctcctttacttcctcctcctccatcttctcctccttctccttctacttgtcattcttcttttcctccaatttttccttaactgttttagaaattatttagaagttctttgcctttctatagaaatcttaaaggacatttctcaaaatcccaacattttaattagggtagcaatgaaacaatagagcagttcaggggaagaaatgacatctttataatatgagtctttcattccatgaacatgatatggctttctattgatttggtcatctttgattttctcctttggtgcttggtagttttcaacatagaatcctgtatgtattttgttagatttatacttcaatatttttgagccatttaaatggtattgcttttatttaatttctactgttgtacagataaaactgatttttgtataatgatctttaatctgtgatcctgataaaatcattttagttttatgtagttttctgtaaattctattaggttatctatatagacaatcatgtcatacacagatagagacatattatatctaacttaattggatttgtttatttctgtttatttatttctccttgcagtcctagtacttttttgcctcatgtattttgatgctctgttgtcaggtgcatacctgataagtactcctacactttctcggagaattcactcttttaccattgtataatgtccctctttatctccgataattttcctttactaaagtcagctttgtctgaaattaaggtatctagtacagctttctttcgttagtattagtgtatctttacatatcccattttcaacctgtttctgtatttatacttaaaatagtttttctatagaccacatgtaattgggtcttgttttttatctgcttcaacaatctctttcctataataggtatatttagactattttcatttacagtgattaccgacatagttggattaacatctaccatgtttgtaacttttccacttattgaacttgttcgttgtttcttttccccctctttttctgcctgccctatttttgactgagcattttatatgattctatatctctcctcttttatcatatcaactatatttctttaaaaatttttgtagtggttgacttaaagtttgtaatacacgtttacagctattctaagtttgacttcaaatagcactataccacattatggatagtgtgggtaccacataacagagtattcataattatttcacttatcctctatgaaattgctgtcattcatttcacttattcatatagtgttatcaccgaatacagtgctactattattacattaaccaaggagttatcttttagatcaattaaaattttttaaaaaatattttattttacctttgtttattctttccccaacactcttcctttcttcatatctatctggatttctgacatttgtcactttctttttccttcaataattattttaacatttctcatagaataagtttactggcaatgaatttttcagatttgtttgtgggagtctttatttcttccttactattgaaggataactccactgaaatatagaagtacctctttttgcttgcatagtttctgataagacatctactttaattcttattctgtttctctctcggggttttttactactgtgtctattagaagctttagtttgggactgctatagctcccaggctaggatatataaaaggcaaaaatgaaactatacaaacagaaaaagccaaacaggggctcactgaatctttctttgagtactgagatccttattcagttatcctgttgtgatccctttcagaatattctaatagatgcttcattatgcattttactccagagtttttggttacagatatggaggaaatagagtgacatatgcttactctatgttgtttgaaaccagaagtgacatttttaatactatgtgtgtgaggctaagtttcttgttaatatcctctgatacatagaaaattttttaaagccggcaatccacccagtgatatccataccgcaagttctgttttgccttctgtaggtggtaattccaatgtcaattaagtttgcacagccttttctatattccctgaagctgcccagtgcatgcattagtcaaggcttcatctaggacttgggccatggattatattgtggatcattctggataccttcactgcggtggtttttgtttagatttgttttgttttttggctctgtgctgcacgtacataggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaactgtcaccactatctaatcttagaacatttttgtcacccccataagctgccctatatcatgagctgtcactctccattcctcttgagcccccaacccctgtcaagtactaatctactttctctatatatgtatttgcgcattctggacatttcacataaatgcaatcatatagtgtgatcttttgtgcctggtgtctttcacgtagcatgttttcaaggttcatcatattatagcccatgtcagtacttcagttctttttagagatgaataatattctattgtctaggtacagacatgccacattttgttaattaccatcagctgatgaatattttgactagaattcaggcattatacttttatttttaacctttcattttgaattaatttcacactgttgaaaaattagtaaaattatttcttatacacccttctcccagatttcccagttattaacagcttatataatcacagtacaatgatcaaacatcgatacaatactattatctcatctaaagaccttattcaaatttctccctctgttgtactaacattctttttctagcacaggatccaacccaggatcacatattgcatttaattatcatgtctccttagtctttttaaatctggaacatttcatcattttttaactttgagactttacatttttaactttaaatatatattatttttatgttatatattttttagaaatagggtctcactctgtaacctagactgagggcactggcatgattgtagcttactacagccccaaactccttggttcaagtgatcctcctgcctcagccttctgagtagctaggactacaggcatgtgatactgtacctggctaatatttaagatttttttgtttagagacaggattttgttttgttgccaaggctgatatcaaactcctggctttaagcaatccttctgtcccagcctcccaaaatgctggaattacaagtatcagccactgggcctggccttagttttatattttaaaagctaagcacgcttactgcagaagaatatataaaacatgtaagacagaatgaatagaaatcacccttatttcattaccattagatggtcactattgacaatttgatctatttctgtccttctattcatattattgaaaatataatttatattctcttttaaaccagcattatatcatgaccattttccatgcattaagaactcttaaaaaacataatagtttcataatggtccatcttgtggttaatacatactgccctccagcatatctgtgatattaaacatttaggttttctctggtgaaacaaaatgaaattagtcaatgtgtatgaactgttttaaggttactaatttgtattgctaaaatgacttccaaaatgatgatatcaatataaattcccttaggactctgtgaaagcctgtttcaccacaccatcctcagcactggggaaattcatctttttccaatgtttgaaaaattaaattccactgtgcctttagtttgcatttccttattagtgatattaacttttaaaaacagttatcaatttgtgtattttctttggtgaattgtctctttgtatgcaaaatataattttttaattataaaagaaatcaaggaaaaggtatgctttacacactatgcttattttctgcctttttttaaaaaaaaaataaaagtaacttcaacatttattttagattcagaggggtacatgtgcaggcttgttacatgggtctattgcgtgatgctgaggtttgggatatggatgatcccatcatgtaggtagtgagcatagtacctaagaggtagtttttcagcccacactccctttctccttctcctctctagtagtctccagtgttgatcgttgtttccatttgtatgtctatgtgtactcagttcttagctcccacttataagtgaaagcatgtggtatttggttttctggtcctgcattattttgtttaggattagcctgccgctgtatccatgttgctgcaaatgacatttcattatttgtatagctgtgcagcattctaaggtgaacatataccacagtttccttattcagtctactactgatgggcacttgggttgattccatgtctttggtattgtgaatggtgcagcaatgaacattcaagtacatgtgtctttttggtagaacaatttattttcttctgggtgtatacccagtaattgggttactggttgaatggtagctccgttttatgttctttgagaaatttacagactgccttccacagtggctggactaattttcattctgacagtgtgtaagcatttgcttttctccatggcctcaccagcatatgtcattttttgactttttaatatagcaattctgactggtgtgagatggttttccattgtggttttcatttgaatttctctaatgattagtgatgatgaggattttttcatgtttgttgtatgttttcttttgagatgtgtctgttcatgtccttttcccatttttgatgggattatttctttattgcttgttgatttttttaagttccctatagattctggatattaggtctttgttggatgcatagtttgtgaatatctgctcccattctttaggtagtttgtttgctctattgatagtttcttttgttgtacagaagttctttcgtttaattagggctcacttgtctatttttgttttagttacaattgcttttggggatttagcccaaaattctttgccaaggcctctgtcatgaagagtatttcctatgttgtcttccaggatttttatagtgtgaggtcttacatttaaatctttaatccattttgagttaattttttacatgtggtgaagggtagtggtccagcttcaatcttctgtatatggctagccagttatcccagcatcatttattgaaaagggagtccttttcccattgcctatttttgtcagccatgtcaaaaatcagatggttgtagttttgccactttatttctgtgttttcttttctcttccatttgtctatgtgtatgttttcataccagtagcaagctgttttgggtactgtggctttacaatatagattaaggtctggtagtgtggtgcctccagttttgttctttttgcttaggattgttttggctatttgagctctttttttgtttcatatgaattttaaaatagtttcttctaattctgtgaagaatgacattggcagtttgatagaagtaaccttgaatctataaatttctttgggcagtatggccatttttatattgcttcttctaatccatgaccatggaatgtttttccatttattcatgttgtctctgatttctttcaacagtgttttggagttctccttgtggagatatttcaccctcttggttagctgtgttcctaagtattttaatttctttgtagtgattgtaagtgggattgttttcttgatttcactctcagcctggacattgttggtttatagaaatgctgctgatttttgtacattgatctttgcatcctgaaactttactacaatttttccttttttttctttcttttttttttgctaaagtggtttatgaattttgggagccttttggcagagtctttagggttttctaggtatagaatcattttgtcagagaagatagtttgatttcttctttgcctatttggatgccttttatttctttctcttgactgattgctctggctagggcttccaatactattttgaataggagtggggagagtggacatatttgtcttgttacagttctcccagggaataatgctttcagcttttgtctcttcagtatgacattggctatgggtttgtcatagatggctcttattattttgaagtatgttcttttaacacatagtctgttgagtgtttttatcatgaagggatgttggattttatctaaagctttttctgcatctattgagatgatcctatggcttttggttttaattctgtttatgtgatggatcacatttattgatttgtatatattgaaccaacctcacatcacaggaataaagcctatttgatcttggcaaattaactttttaatgttgattcaccaagatcaagtagaatttattctggagcctacggactggcgctgacattgtagaatgagtaagggaggagcccctcatccctgattttttagaatagtttcagtaggattggtacccatttttctttgcatgtctggtaaaatttggctgagaatctatctggtctggggctttctttgattggtagtttttttttttcaattgttgattcaattttgaatgtgttattgttccgttcaggttttcactttcttcctggatcaatcttgggagattgtatgtttccacgaatttatccatttcctgtagattttctaatttctgtgcatcaagttgttcataatagtctctgaggatcttttgtatttctgtggtatcaattgtaatgtcatctttgtcacttctgattttgcttatttagatcttctgggtttttttcattattagtctagctagagatctatgaattttgtttattcttttgaagatctaggtcttggtttcattgatcttttgcatggatttttgcatttcaatttcatttagttgttctctaattttaattatttatttctctgttatctttggggttggttcttttttttttttaagttcctctaagtatggtgttggattgttaacttgaggtctttctaacttcttgatgaaggtgtttagcactataaactatctccttttaacactgttttagctgcatcccaaagattttggtaagttgtgtctatattttcattaatttcaaagaattttttttatttctgccttaattattttgttcatgcaagagttactgaggagcaagttgtttaatttctctgtatttgtatagttttgagagatcttcttggtattgatttccatttttattatggtgtggtccaagagtgtgcacagtatgatatcaacttttttgaatttattgagacttccttaatgattgagcatatggttgatattagaatatgttccatgtgcagatgagaagaatatatattctgttgcagttgggtatagtattctttaaatgtctattgggtccaattggctgagtgtcatgtttaaatccataatttttttgttcatttctgcctcaatgatatgtcagtaaagtctgtcagtggagtgttgaagttttccattattattgtgtgggtcttcttgtagttgttttatgaatctggatgctccaatgttgggtacatatatgtttatgatagttaaatcttcttgttaaatcaaaacctttcattatgtaatgtccttctttctgctttttgtttgttgatgttttaaagtttgttttatctgatataagaatagtgagtagtgctcttttttccttcctgtttgcacggtagatcctgctacttttagcctgtggatgtcattacgtatgagatggatctctaaatgatggcagagagtttgatcttgtctttttatccagttggccactctatgccttttaagtggggtgtttagactgtttacattcagggttattattgatatctgagattttgaccctgtcatcatattgttagctggttgttttgtagaattgattgtgtagtttctttatagtgtctgtgggctatgtgcttaagtgtgtttttgtggtagcaggtatcattcttttgtttccatgtatagcactctgttaaggacctcttgtaaggttggtctagtggtaataaattccctcagtatttgcttgtctgagaaggattttatttctcttttgcttttgaagcttagtttggcagaatatgaaactgttggtatgaaatttctttttttttttttaaggatactggaaacaggctccctatgtcttctgccttgtaagaattctgctgagaagtccactgctagcttgatgggattccctttgtaaatgaacggatccttctctctagctacctttatgatgttctcttttgcatttaccttgatgattctggtaactatgttccttggggattgtcatcttgtatagtattttgcaggggttcttggtatttcttgaatttgcatgccagcctgtctagcaagattggagaaatgttcatggattaataataatgtcaatgacttgtaggtttggtctctttatataaccatatatttctcagatgttttgttcattttttaaaaattattttttaaaaaatttttatctgagtttactcaaataactggtcttcaagctctgagattctttctgtggcttggtctattctgctgttaatgcttcttattgtattatgaaattctcatagtgaattttttcaattccagaagttcagtttggttcttttttgaaatggctattttgtcttttagctcttggatcattttactggattccgtgaatttctggattgggtttgaatgttcttcttgatctcaatgagcttccttgccatccacaatgaattctatgtgtgtcattttagtcatttcaaactgattggataccattgcttatgagctagggtgcttatttggagggaaaggaacactctgactttttgaattctcaggtttcttgcatggattctttctcatttgagaggactggtgtttctttagctgtagcataagttgagtataatcaattggctttgtttctgggcgctttcagggtgccaatgctctgtacaggatctgtacttaaagctggatttttgccccttctctaggagctatttggggccaggaactgtccctgacatttgacaaatctatgcagggttcccagcttcctccctcttcagccttggggtctgcctcacctctcttttgactcttggtattttctctttgaaaatctgttcaaaatatgttagcttacccaatttttggtctttcttggtgacagcagtgcttcctgactgtgtccagttggacgtcttgtccagaacccctggtgattatttttaaaatgaagctttgttgtagcactcttggccaatttaatataatgtccttttttccctttataagttagccttcatgtcttcagtctacacttagacattcaggtcctaaatattacctttgcatattcagtatacaccagctccattcatagctgaacacttcaccaggttcctaattcctgaaagaacagaagccatatctgtatcccaggaggctggggcgacaagatggtggatctccccttattttcttttcatacattttttcaccaaaatttgacttgtatttgcagctatctgctatcaaacactagaagttattctttctcactgtatttttgtagctatcaaccaacttttcttcatccctctctcccctctacttttctcaacctctgttaaccactattctactttttagctccatggcataagtattttttagttcccacatatgaattataacatacaatatttttctttttgtgcctggcttatttaacataatatcctccagttccatctatgttgctgcagaatgacaggatttcattctttttatggctgaatattccattgtgcgtatataacacattatccatttatctgttggtggacatttagcttgattccatatcttggctatggtgaatagtgttgcaacaaatataggagtacagatacctctgcaatatatttatttactttcttttggacatatacccagcagtgggatttctggatcatatggtagttctactgtttataaattttttgtactggctgtgctaattctaattcccaccgtaagtatatgaatgttcccctttctctgcatctttaccagcatctgttattttgtgtctttttgataatagccattttaactgaggtgagttaataattcattgtagttttgatttgcagttccttgatgattagcaatgttgaacattttttttttcatatacctattggccatttgtatgtcttcttttgagaaatgtctattcagatcttttgcccattaaaaaaaaatcagattgttattaatattatttttgctattgatttccttatgtattttggttgttaatcccttggcacatgtataatttgcacatattttctcctattttgtaggttatgcattcatttgtttattgtttttgttttttgctatgcaaaactttttagtgtgatgtaatcctatttgtctctgagtcttcttatccttatcttagaaatgaatctaatactatttgtctgtctgtgttgttggctgtgcttttgaggtcttactcaaaaaatatttgctaagattgttatcctaaagtatttcctcattgttttcccctagtagtttcatagttttggttcttatattaagtttttaatccatttttattttatttttgtatgggctaagagataggggtctaattttattgttctgcatatgggtgtccagtttttcccacaccaatcattgaagagactatcctttccccagtgtatgttcttgatgcctctgtcaaaaatgagttggctataaatgcctgggtttatttctgggttctctatttttttccattggtctatgtatctgtttttgtgccagtaccatgtaactctggttactatagctttatagtacattttcaaatcaggcagtgtaatgcctccagctttgttctttttgctcaagactgctttgggtattccaggagaatgacatttttgaagaatactagccaattattttatgcaatatccctcaatttagaatttttagatgcttcttcatgagtaaatttagatgatgcatatttggccagaatagcatactgcatccttctcagtgcattgtatcaggaggtatgtgatatcaatttctcccagttgtggtgataccagctttgatcacttggttaaggggaaatctgtcaggtttctgaaaagagttcctgttttcctttgtatttaataagtatcttgtggggagatattttgagactgtgtaagtatcctgttccacatgataatctccttcactaagtttagcacctgttggtacttacctacaacagttattaccgtggtgtttgccaaatggtgattttctactctcatcacttcttatacatttatttctccaaatactgctgtgagaaagagtttaccatgctctcctatttatatatttacttatttataacattgtggtctcatggattcttactttattctatgggttataatccattactgttgttatttatgttgttgatcaaactgttttaagatttgcccattgggagactgttccatttgactcttgactttttttttttacatgcccttgttatttattgtgctattccttattttcttttataagttgatcttatacttttctttgtctggaattagccatttctccaaggaaatctgatgacttttactggaggaaggtacttagaaatcatgatctggaccgtgttctattttatcttctccctatgagttaggcacaattagcaatcctacatttttaatgaaataactgagaactcaagaagttaaataatacatctgatgccacacaactgaaggtgatagaactactatttgaacccagtctaaagtttggtctccagtgtccatacttaaatttaatttctctctgggattggaaagcttttccagtgtctctgagtcttcttttccttgtcttagcaatgagtctagtactatttgcctctcagtgttgttgtgatggctaaatgaaaggacacatcggaaattgtctatacattatttgttccatagtggatactcaaatatacgttgaatttgagctatattcactcagtattcataaacacccactttgttcgcagcactgaggtagaaaatatgcaggtacatgcatatttcctggtaagagctcatatttcctggcaataatttctaatgtcactccttcctgtgcatccaatataggataccagaatcctttccaagatagaatttaggcagacactactgaacaaatgaaacgtatttgctgccctagacatgagtgatgaagggttgggagaacaggcgtgactctaccaaaaacaggcagataatccaggctcacatttcaaaacaccttgcaacttaagtttctaaccattttctaacagtccttgaaattatgctaatataaggacttccaggcaacatagaagactgggtgtacatgctaatacacaaatgacatagaggatcagcatcccaacttcttggaatatgccagacagtaataaatgtaacagccacaaaattccagccttgcttaatttggggaaatgagaatcagtttgttcttcccctgctggcactgaacagtggtttgcaggatcactgcgtgggaaagatctgacagtagagatctgagaggctgtctgtgtgaaggctgaatttcatgaactatctcattgttgggatggttccctttcagcctcgtggtaagtacaacactcaggtcactgtaagcgcagggcaggcaagcttaagccacaatgagtgaaaatatgtgtgtattgggttgggggaagggattttagtctggattatctgaagctcagactttaagctgagagcctgggctgccaagcaggtatatgtaaaggacagctcaaagctgaggtttaaaactagtatgctccaaccaggctgtgaaagtaactaaagtagctgagtgcctcagatcacctaatgtttatttttgttttgttttattttttgtttttccatttttgttgttgtttgtttgttgttttttctgagacagagtctggctttgttgtctaggctggagtggagtggcacgatctcggctcactgcaacctccgcctcccggattcaagcgattctcctgcctcaacctcctgagtagctgagactacaagcgtgtgccaccacgcttggctaatttttgtatttttagtagaaacggggtttcaccaagttagccaggctgttctcgaactcctgacctcagggaatccacccaccttggcctcccaaagtgctgggattacaggcgtgagccaccacccccagccgccctaatgttttacaagtttgagacataaacctgtggcatgcttttttttgggaacatgattcagaaatcactttttcctatcaaaaagcagaaaaatgagccatgatgattggaatccttcctgatcttataggtagactgggaaagcatagctgggaagagcacagacagggagatcagaagaacctcggactgccacaaaatgtgtaatgccaggtaacctaagccagccagtcaatttatctggggatcacttcttcacttgtacagcgaacaagatgaattagataattgtataattccttggagctctgaaattctactgcacaaatagatgcctcgtgatcgctgttgagatgaggtcttccagagcctgtgatcccagatgtgattgatcatcttgccagagctttagccaccttctcacctgttagacaattcctgcccctgtgtctctactgtatcgcctttcacagctcatatgctgcacctatgcagtcttcttcagggtaagctgtgtgaagtttaagtttcttataactattaaacttcatcttgcaaaggattcttcctttgaagaccaggttgcaaagtaaataaaaatgaaactacacttgataaagcagggatgggaagtctgtaaccttatccttattgtgggatatttgaattgtctctattttttgctatttgtcttcaagttgtcctaagaaggtgggatcaatatcccccatcctattggttcagagtcaagactaatgatgccacacatgcatgaagagtgtatggaaacatttattatttacatcatgaggctttctagggagagcagaggaaacacccaagcttttctattagatttgagtgaggaaggcacaagtggctttggtttctactgtgtgtgggtgtgggctggcattagggctcccgtgtacaggctcaagtttacgtggtttgacttctatgctagtgccaaggaaaggagggcctgggatttttttttaattggcttgctcatgtgtgaggggaaaagagaagtgggagaaaaggggtctgaaagctgtcagcagccagataatggagtcagatgatcttacatattagaaaattccaaggaaaccactaaaaacctattagaactaatacatgagttagcaagattgcaagatacaagatcaatatgtgaaaaatcaattttctttctatacatttacaaagaactatccaaaaatgaaattaagagaataatttcattcacaatagtatataaatatattaaatatataggaataaatttaatataatgtgtaaaacttacatggtgaaaactcaaaacattaaaaaattaaagaagagcaaaataatagaaagtccatattcatgaattaaaagtcttaatattatcaaaatgacaatatttctcaaatttatctagattcagcacaattcctatcaaaatctcagctggcttttttttttttgcagaaattgaccagctaattttaaaattcatattgaaaagcaagggatccagaataacaaaaataatcttgaaaaagaagacaaagtaggatgacttgctggtatggtttggttctgtgtccccacacaggtctcctcttaaattgtaatcttgtaattcccatatgttatgggagggacccagtgggagatgatttgaatcatggggatagtttcgcccatactgttctcgtggtagtgaataagtctcacgagatctgatggttttatcaggggtttctgcttttgcatcttcctcattttctcctgctgccactatgtaagaagtgcctttcatctcctgccatgattctgaggcctccccagccatgtgcaactgtaagtccaattaaacctctttttcttcccagtatcgggtatgtctttatcagcagtgtgaaaacggactaatacactcacacttcccaatttcaaaacttcaaaaacagttatgaagaaagtatagtactagtatgaggataaatgtatagatcaatgtaataaagttaaaaattcagaaataaagccttacatttaaggtcaattaatttttgacagtggtgccaagacatttcaatgggaaaagaacaaccttttcgacaaatgatgatgaggcaacagaatatgcctgtactcataaataaagtttcaccccttccttatacaatatacaaaaattaactcaaaatggatcatagactaaatgtaacagctaaaatgataaaatttttagaagaaaacataggagtaagtcttcatgaccttgggctaaacttcttagcaatgataccaaaagcaaagcaaccaaagaaaaaatagtgacccttagaatcaccattaaataggaagatagtaccccttgtattatgggccttaatttctataggccttgtttttttaatctgtattgggacatattaactattttaaccagagatggattattctattttaggttcgtggtattccatttttttaagctgattttcaatgtcaaagatttaattttatttcaatttattactcattgggttaggtcatatctactacgtgatatatgttaaggcaacaggtgctaaggccatggagaatttagagaaggaaagtgtaccagtagtcaaggtgaggcatacctgtttgccctctactttgcatttggtaagcaccctaagagtatggtaactctttattacatatagatcaatgtaataaatttatgtttaaactcttaggggagttaccacatgcaaaatagaggacagtttaaatttggtgagatccccaaacataactgtaatttgagccacagaattagttaagaccatgaaggtttgccaattcttttcagcttagcagattttagagttagtttcaaaccctgtgttttaaaatacaaaagctaattggcatcctttttacttttcaatttttattatatatttttagtacattttagatttctaattggatcaaattatggatctctgttttagtttcccccaccactcacttttatttacttgcttttaaatttgacggttgctggatacactttaaaggggttgtgtcttctttgttcagatgtatatatacacattttcccttcagagagtaccaactcattatcatcaagctgagggacctctcccatggcagttgttttattggatagggtactggcttaagtagagtttgaattagccctttaacatgttgataagccacatcactcaatgaacaccgtgtctttgttggtcaattttatatataatagttgtctgttagtgtcctctggccctttaagtggggcagggataatgcattcaagtctacttctcataaaggtctgtgctttggcagccatggatactctttccctttaactttgaggatcaggttttcttttggtggcagagggataggcaggtcaggtatgtgtgaatgaactgttcctaggagtgtagacctcagtatgccacagggtgactgtttgtgacacaatggcacccaaagggtccatgtattacatagcttatcagtatcagtcttttctgtcattattgaataggattctttcctggttgagacacagaacaaatagtattagggtaagaattgtttccctgaacctatcataaaccacagcttatgctagaatagagatttaatctgaggcacaaagataggcccaggctgagacatatgacctagggcaactttaagtagcaccccaatcccatactctcgtccctaaatgccaatattgaaacttcaacttaggttgattaagtctatagaagaggcacagtaggactcagcaaatgcagctcaaaatacatgctaacctgcagccttccaaagtgtctacttgcctgccagaagcagagcctgttagcccaccaaaagcaaaggacaaaagctccccaggtgatagtggccatcacctagatcatcctcatcaaagggccagttgtcaggtggttgcttagcagagaagtggaatcaatcaccccctcccaaaattggttcagatgtcaagacggacaatgccacaaaagcaccaggaaggtgtgaaaatattcattacatcatgaggctttctggagagagcagggcaggcatccaagtcagtttgtttggcttgagtgaaggaaggagcaaaagcctttggttttttattgtgcttagggagtagtgttggggagagagttcccacatgtgtgccaatttttgcattatttgaacttccctccttgtgccaagcgagggagcacactggctttcttaccagcctgcccagatgtgaggctgggggaaaagtgaaggagtgcagcctgaaaactgtcaatggtcaaatatcaaaactggaatcacatactttattacgccatttaaagtaatgccattgtagcatgctggtgcacacgtcttcatgggatccatgaagaaatgggcttcctggaaagctagaaatatgaagatagtgcttttgttcaagtacaattggtactgactactacctctacctgcacaagaacgaagaaagttcttgcctataaaactgctaataaatggatgtgcataaattattgtaatatattcttctggcatgattatgcaagctttgagtgtaaagggcagttgtattgaaaaaaaatgagctgtctattaccttgcaaagacatgtcccaacctactaaacatgcctttcagggactctgagaactaagaaataccatggtatgctgtgatgtgctgtttctgcttctgttctgtgtggccacttcacttatgggacttaatctaatcctaaaatgtgggagtatgtggaaatgtttgttcttgtaactccatagttcattgaaattaagtgtaaagcatttctgaattagctaaatgttcttcagctaaatgtctagaaaataaatttaaaggccagtgtatctatcaaaaaaaggttttggaaactttcattagttaaatatgattatttggggcaaattgaacctcgaatttagtggtgtaatttcactaacttaagtatttaagccattaaaaaataatgaatgtatattagaaagtatggtagattagacactctgaatacacgtctttttttctcttttttttgagacagggtttcactctgtcacccgggctggagtacagtggcatgatcttggtttactgcaacctctgcctctcaggctcaagcaatcctcccacctcagcctcctgagtacttgggactacaggcttgtaccaccacacccagcaaatttttgtattttttgtagagacatagtttttcctgttgcccaggctggtcttgaactcctggactcaagcaatctgccgcctcggcctcccaaagtgttgggatttcagccgtgaggcaccatgcccagcccccatcctcttaaacagatcttatttctagataaataattattgttagtgcatttctgggtcagctagaaataggagctatcaccaaacaggagaaaacttaagaaaaatgccaagctgaaatcagagaaagaagtacgtgttttccccaaattcagacattgaaatatagagacaaagccttggacccaccatacactgggggatatgaataaaaaactcctttgttagatctggatccttgaagtttaatcaagtggtttcttatttgtagcacagatccttcctaaaagaaagtttcataagcttaggctgtcaagatttccacaggttgataaaaggcaaatatgagctcatgatcagaaattagcaaacacttaaggaaatctcacataagagttagcaaaagaaacagatttgaatgccaaaatggtatcagatattaaaattatcacaatcagaacataaagcaaatttgtatgaaatgattaaacaaataaaggtgggttaaaacagagaaagcaataagttttttttaaaattattttattattattatactttaagttttagggtacatgtgcacaatgtgcaggtttgttacatatgtatacatgtgccatgttggtgtgctgcacccattaactcgtcatttagcattaggtatatctcctaatgctatccctccccactacccccaccccacaacagtccccagagtgtgatgttccccttcttgtgtccatgtgttctcactgttcaattcccacctatgagtgagaacatgcagtgtttttttttgtccttgtgatagtttgctgagaatgatggtttccagtttcatccatgtccctacaaaggacacgaactcttcattttttatggctgcatagtattctatggtgtatatgtgccacattttcttaatccagtctatcgttgttggacatttgggttggttccaagtctttgctattgcgaatagtgccacaataaacatacgtgtgcatgtgtctttatagcagcatgatttataatcctttgggtatatacccagtaatgggatggctgggtcaaatgatatttctagtcctttttaacaagtaaccagtttgaaaaatatccaagtaaaactttcagtataaaaatattattgtatatactttaaaacccacagttaaatagactatcattgaagagagaatattagtaaactagtaagttgctctaaagatattaatatatacagaatgcaacactgaaataaccagaaatggaaagtctaagaggttagatgatatagaggcttgaatgagaaagtttttcattcaacaaatcaaagttccaggaagagagaataggaaaaagataggagagccatacttgaacaggtggcagctgagaattcttcaaaatgatgaaaaccatgaaaatatatacgatacatatggcaaagcatgcagataaacttaaaagccccacctaaccaaaaatattaaaactgcagagcaccaaaaacaaagagaagattttatgagtagccagaagacaaaagttacctataaagaaatgacaattagaaggcacaaggcagatttcttggcatcaaaatggaagcagggaagcagtggaattatattttcagagtgctgagagaaaaataaatatcagcttggaattgtgttagaagtaaatctatctctcaagaaggagtgcaaaataagaaatattggtatggacaaaatggaaagaatttactaactgtatattcaactaaaagaacttctaaagcaggtacatgagaaaaggtataaattatcctggaagaaaagtgtgaaatgatttaaaggaatcatgagaaaaaaatggcaaacatataagtaaatctaaaccaacactttctttattaaaacataatttgtagattttcacaaaaggacagaaggaaatcactgtcaaatgtaacatctaagtcaggaggaagtgatcagagtttaaatgttcaggcaaaggatttaagatattaatataagattttttagatcagcaatttgtgatatattttcacgaatcaccgccaaaaaaaagagtgtttaaatcccaacctagtgaagcagagaaatatatatatataaacatatatatatatatatatgtaatcaagaaaagagaaaaagaagcttagaagtggaacaaatacaaattccgaagtaatatgctagaaacatgtctaaagggatcaaccatcacaatcactaaatggactgaactcacaagtgaactaccgacattgtcctattagatgaaaaaataaataaacccaactatatatcctttaaaatatatgtatgaaaatataaggacacacatgtttgaagatataccaggcaatggcaaccaaaacaaaatgagaatatctatctatatatctgtctatctacctacctacctacctatccatctatccatttatctatcatctatctatctatctatctatctatctatctatctatctatctatcatctctatctgtatctctgtcgaatagaatatatctctcatatatagaattcaagacaaaaagtattactggggacgaagaggacctcatgtaatgatagacctttcgattcaccaaaaagattttttaaaatctaagtttgtatgtacctgttaaaatattatatttcatcatacctaagataccgacatttgtaagacgtgctgttattttatctaccactgtcaacagtaaaaaactcctgcaactaaactatgaaataatggtttcatattatgtcaattataagagatcttcattttgagatgttaaatatgaaaaaaactgtcttagaattaatgaagtatgatagcttcacaccacttaaagcaactatttatgtaagagaaaaatatataaaaatctacataacagtaaaagatttcaaaatatttctttcaattgtgatagctcaaacagaacaaaaaaagatataagagatgaataacaagctgattttaatggacatatgtagaactgtgcacagagaacacacattcttaagcatatatggaacattttttaatttgaccacatcttaagctataaaagcaaatgttaacaaatttcaaaaactaagtatcacatgttctctgactacaataaaattttaatttagaaatttatactaaaaagttaactagaaaaaccccatctgttggccaggtgtggtggtttacatgtgtaatcccagcactttgggaggctgagaagggtggattgctggaggaaaggagttcgagaccagcctgggcaacgtggtgaaaccccatctctaccaaaaatacaaaaattagccagtctcataacccagcctcaaaaaaaatttttttttgaaattgaaacacatggctcataaaaaataatggaaattaaaaatccctagagttgaacatttatgaaaataccgtatattgaaaaagtggcatgcattcatttataatgaaaatctgtcaaggaacaaggagttgaatggaactttttagctaaataaagagtatctacctaaaacaaacaaaacctatagcatactttgttcttaatggtaaaaagttagaagcatttcttgtaaagtcaaaagtatattcaaagaaaagtaaattttcccttccatccagactgtcctgcagagacaaaaacatattcatatatgtttggcagggagaaggacataaagagaaagattttgttttggtttggcttgttttaagatttttttaaatgtttgatatacggtgacagctttcccacaaaactgtactaattgaaacttctaccaacagagtgtgagagcattcatttcactacatgatcacaaacattacgtactaccattttaaaaaatagcaaaatgcctctttaaaaaatttatatgatgccttgtgggactcaacttgctcaatgagtttattgactatttttatttttatgttataaacagctcttcttatggagctgttaataatgtttgcttttatttgtaagaaatgtttactaaagtaggtaataatccttcagctgtcatagatgataaaaagcatactttttttaagtttgtaatttgggttttacttttttatggtgttttaccatggcagaggaaaactttttacatggttagacctaacaatattttcttgtattttttcttcctttgcttttattgtatatccctagagattggagagtctctaatcgtttgtggtgatcgttgtctaatagttacttttcttgtgttggagtatctggttaggattgcaaattcatttagtcctaatatttattaaacagtgcttcatttcctcactgatagaaaatatcaactttatcatagtatatattattttgtgatagaatcttgttcttttccttctattttgtaacactaatctttcagtttttttttttacaagttccatgttgtttaactattgcagcattatttctgagatcatgataattcttattactcaccctgattattcttttttcttttttgctcctttttattggatactgttttaaaaattacaaacattatccaccctcttctatttcaagatgacgtcaactattctttttaaatgtattaactaagaggaatgcagaatcattttctaaagttaaaaataaaaacttgtccaatctctgatatatttttttaatagtgtttgacccataaaattagggacatctgaagtaggattctaaagtaagaaatatacctgtttgtttggaaaggtagaaaggaaatagttacattctcacgtaaccaaagttttaaaaaattatctagtgtcatttatctgacattatttctctaaagtgcctcatcaactccagccagacaaatctcttcattattcctgcttcaggccatgcacatttcaaattctcaggctttgctgagaatgttctttgccagggatattttttctctttctttctgtttattaaaatttgtttctttaaggccaaactctagctccttcatcatgaagcttcttttagtatatgttccacagagtttaaacattttagaactttttctaattataaaagcaagaaaataaactcatagaacatttgataaaaaatagagacatattttctataatattaactccctattatgaattatatatatttccttgcagtatttcatatgaatacatagttgtaactctagtgaacttacaatttcatgttctatgttagcatggtttcatgcttttctctgttgctccattctattcattattaccatttttttttttttttttttgagacggagtctcgctctgtcgcccaggctggagtgccgtggcgcgatctcggctcactgcaagctccacctcccgggttcatgccattctcctgcctcagcctccagagtagctgggactacaggcgcctgccaccacgcccggctaatttttttgtatttttagtagagacggggtttcaccgtgttaaccaggatagtctcaatctcctgaccttgtgatctgcccgcctcgacctcccaaagtgctgggattacaggcgtgagccaccgcgcccagccccattattaccattttaatgactatccaatggtccatagagtcaatacataattatttaaataatctttgctttactacctgtcccttatcataaaaagctctgcagagaaaatctttgttgtgtagctttcctttctttggggaattagttccttagaataaacatcaagaattggaatttaggggagagaagcgaaaagcattttcaggctcttgaaatgttttttcaggtggctttcattcaccagttttatgtatgagagttctagtactccagttgacttgattccctcagatataaatattttttcgttattatttaagaggaaaaaagcatgttaagcattttgccccaattctctgttattgtgtattagttagctctcatgtattaattttgtttccccaaagagactgtaaggtccttgcatgagactagagataatgacttatatttattctttataccccacaatatctccccaaaagtgtggcagacacagttgtcttcagtatttgcttcttaagtgattgaaaccttcacaaaattcctttttgttcctcaaactcaaggccaattatgatagaaaatttggcaagtagcatatttgtggagtctcagctccaaaaataaacccttacccaaacctcacttgtaggggttaaacttatgcttggaatcaagattaactgaaattttcaataaacatgtgtatattgagtttttcttgaatttcagactcattttatcctagttcttatccaattaattcacaaaacataagctatttaaccaccaccattttcagagattgctcataggaagaccaaagaacatagccctagtcctctaaaactggtgtcctaggatgctagaaagtcccttgcctccacaggaaagcaaaaggcaactataattgaagtaccctattgccatgtgttttcagctacacttgttccccactttatcctagttctagaacggtgccagggatatgataaacagtcaataaatatttgttgagtggttgaatgaatctgtgtgcataggttgaatgaatcaatcactctgcaaatatgtattgagctctcgcaagatgcaaagcccagtgtactggttactagaaaaacagataaagttgatggatcttatacgtggcagtgggctggatttaatgaccttgaggtttcatccagtgcatttttctacaactcatgtgcatttcttttgaaacttacacgtcacatccacaagccgaataaaactcctcaagctgcatttctaggatgatcccccgccacctctccctgagggcctgaaaagttgtatgctgctgatttctggtgcgggcaactcctgggcagggacaaggatggctccagatggatggatgcctttgtggagggctcccttttatccttagttgtaagccgcctgagcagttatattataaatgggtaatttaccgcctcatccccaaggcctcttctgtgggctctttcatggacactgttaccaaaagttaccaatatgcctggtgcctttgatatttgtgggcactgcagaccagagaaaaagagttgctgccttgtacagctgcacactggctttcacatgtcctgcaaatgggtacctgccagccatcttccccagatgtcatactgaccattgatttttttttttttctgcttgctattgcagttattaactacagtgaggcctgggcacttagctctccactttaattattcatccttatgaagaaaaatttcccccgtgtgctttattgtcctccagccccgacctgagctcacgcagactcttccttctttccctccccaaagtggcttgtgtgtcgaagggctttccactggggtgcttattccatttatgcctttagtatgcattttgtgttctgccaagggggtcaggagggcacatggagaagccagatggcttacctcttccctcaggaaacacgccgctatttagctgggcaccttcccaactcaaggcggggtgagattccactgttggagagagagttggttcaaatgccactgtccctgagatcacagctccaagttcctctaggctatgcacttttctacttctctgccacttgctggagttttctgccagaaacagccttttaggagatattagaaaggggggtgggaagggagggatgggaaaaagcaactcttgttatttatggtcctcgttcaggcacaagtttctgttattttaatccggctgaaataagaaaccataatccatggatgaaaagatggtggacaaactcagttaaatcttgagcaccctgaggatgtgtgtttttccctatttctggtttttgacgttccttccctgctgccatttcccaactttaacttttgaaaagccaagcagtttggctggccaggcccagggaacttatttgtatgcagcacaaatttcagaatctgttctcagcctgtgccgagtgaaaaatggcctgcattttcttgatagcccatgtggttgtaaagaataaatggctaatgaattacagatgaacattgacgcaaattaatcttcccgctgtccctgggttatatggcagccatttaaaagtttaatcaatacactaaagttgaaaacatgcaggcactgcagttgtttggatgtaataaacatcagagggaaccgggaggtttgcacccagtccatgtatcataatgacaggtatttatgtttaatggactaaatattttttattggaagggagcaaatgtcagcttaactttgtgagccccgcattcaactttcctttgaggttggtgaaagacggctgacgtgtcattggaaatgaaatgttaagggagaaaaaaagcacaacggagacaaagcgaggatgggagccgtttggagacgtggtgcagcgcttacattctgcagcaattcattaacgaaaacgtaaactctgatatttctaatgttgctgtaaaatggtttactaggaacaactttaatggttattagtgaaaacaagtacccagatctgccagatatccttttcagtgcaggcttttgtttgaaaactctttaccaggtcatatttgctggagatttataattagtctttttccttaatgtgagaagtggaggagaaacagcgtgatggctctcagctcttgtattccatagatctttccttttgaacggtgtccaatgacttcgaataaccatgtgttctcttttggaatacttatatcttaattacttttcaagtcaatattttgtacctctgccgtgagtctggaaggaccagggtagctaaaagagaaaggaaattgccagtggcagtgccatctcgctggacaaaaacaggctgagacacaggagagcaatggcttcacttgaacagaaaaatacagacttagttcagcttttcattttttttcctccacatataaaataaactaaatatgtcagtggagcatggggtcttagaaaataacacacactttataaaaataattagaaacgttttagacaaaggatatcgtgtttttaatgtcccttctgcaaccaattgtctcaggtcctcttcagtgtctgagggcacattcaatggcagggcttggaagaaaattattcagtagatagcaagatgaggctgaaggatgagaaaaagggacaggggttgtgatacttatccagtgttcagatcttgcaaaagatatgaattgcacctttttatgtgttaaataattttgttaaaatcacaagaatttgtgtttctaatgggcctaagtttcataggtaatcagtattatgtgatactaaattagtaaaccaaactgatgggttcattggtccttcatcatcccttaagcaaaatggggagaaactttctgttatgaaaaccgaagcatggctcactgttaaccatgatgacatctcacccactactgctcctgaagtcctaaactctatttttcttcctacctctttctaccctcttagaggattgagtcctttacctgtttgttcactttgtgtttccgccgtgtgaatataagctccacagtagggggtaggaggcaagaacctgattttcttctttgcttctagtgtcctggggcctggcctataataggttcttgtaaatggcaggtaagtgaatggcggactacatttcttatggtctttagtaatttataactccggctattttttttgttagtcagtatgatttctagtcactgtgttagttgttttacatataatacaatacttgatcttagttgttaactctagaagataagagttattatcttcattttatagaggcaaaaactgatgtcaagagaattgaagctaattatttgtggttactgttagtatgtagcaattccagaatttgaatcctgacctgtttgtctctgtatcagctatacagtactccccaaattcctgtcactcatcttgtccctggggattaaaatctcattaagtgaccacaacatttaattctagactataaccagccagctccccaactggctgataatgaacagaagtattagattcacaatttgcaacctaaacctggtgtcctgagtcctacctatagaaagcaatctttgactgtacaaaagtagcacattggctatttgatgatgggtgatatgtcactcaaatatgtgtgttctgtggtctagggaaatacaaggaactctctcaaatcatgagaaaagtgttcagcaacagaaatctaacaaatagtgactgaaatgcataggcattaatttcttcactcagaagtgagaatggaggtaggcagcccaggacagtgatagtggctgaaagagcagatcagtaggcacccaggtcctttctgtctttctgtcctactaccttttcagcatgtgcattttagcctcatggtctcaaaatggttgctactgctcctggcatcatttcctcacccaaagcaagatgaagaaggatgtctttcccttatgaggcattcgcttttcatttgtggatagacagcttcctaaagatgtctgtctctttctcattacccagatcatgtcattgggaggctggaaagtcaaatgtttcagttttcatgctgttatagtagaggaaggcaggataaaagggagccaatgcatagtgtctcctatgtaagataaatcgcattttttgtatacctaataaagacttgaaactttgctagatgccatatgcacatcaacttatatcatgtttacaaccaccttgttacagaagagtatttattcccattacactaagaagaggtgatctcattgttcaattcccacctatgagtgagaatatgcggtgtttgaaggggaatatcacactctggggactgttgtggggtggggggaggggggagggatagattgggagatatacctaatgctagatgacgagttagtgggtgcagcgcaccagcatggcacatgtatacatatgtaacctgcacaatgtgcacgtgtaccctaaaacgtaaagtataataaaataaataaataaataaataaataaataaataaataaataaataaaaatgccctaaattatcaggtctgacaaaaaaaaaaaaaaaaaaagaagaggtggagctgggatttagagctacatttgtctgtttctatcataggtcttctctctaatgccatgtttctttggccaccattttgatgtcatagtgaaggatgatttcatagtgaaggccattcccagttgttccagctcatggtgaatgtgctgtcttctgagggcacttaacagttgggtctgcctctttgataattaagtatgcactaccatgtgccagcttccatttttgtgtattctgtacagagtgtttaagaaggtgggtcagagactcactgtctagatccagatcttggctctataagttactatcagtgtaatctcatgcaaattacataacctctctgcagattgaacttttggagaccagggacatgattttttttcccctcttgatatctcctaaaacactgacaagattctatttcacattagagccactgagtaaaaactcattctagaatcactttgaatctttgtttcattgatttaacatctttttgccttagcttctgaatcctaaaatggggacaagaatacatctacttcatagggttgttgtaatcgttgaatgagataatgtacctacttaaagtttttagaacagtgtgtgatgcatagaaaaagctcagtgttagctataattattataatcattcatggattgccagtattcaaactctaaaactccatgggatataatataatctgtaatgtatccaaaagcaatttttcttaggccatctcaggtacactattataaagaataaccatatccttctggtgaagccatattgagcatctcctgcaatccagggagtgtggtatatgttggagatacaaaaatgcataaaacacagtgagaaacatgtggtaatgaacaccatgagcaatattcactctcgataataaccaaatgcttaaaaagtaaagcaactcttggatataatatttccacttattaaactagcaaagatgtttaaataggcatgcctggtgctatggagtggattgggtgcatattaatatgtttttgaaaagcattttggccctgtgcattgaggctagatgcattcacttaggaatctattccaagacaagaatccaagatgcataaacacaggatctttatacactaaaatattcactatagtaatgtttgtaacatcaaaacacacaaaaagtcattatccaactagataagaaagctaaataaattatggcacattcacagaacacaatgttatatagtattcaagtgatggttacatcagatttaatacgataggcaaatatttaagtaataaaataaatgaagatggatatatatgaatgcatccatacaacatatggacagaaaaaaggccagaaggcaaaacatccaaatactaactgtggttagttctggacagtggaattatatatgatttttattttttaaatttacacttaatttttttacaatgaacatttaaatataataagaaaacaattaaaataactccccaaacaacaatatagtctttatgaaaatagtttcagagagaaggggagtgataataacaaaaagagtttatgtgagttagttaagaattgtattcagctacaactagccccaaataccagtagctttaagaaaatactgtcctataacatgaatttcagatgtaggcagtccatagctgttatgatatcactaggaacacaggcttctttgattttggttctatcttccaacagactggctcccatcctcaagtttgatttatggtcaccatattattgctgttgcactagctcttctttccaagttccaagtagcaggaaggaagaaaaggcaaggtgagcactgctatgctcaacagcataggggctctgtgtataagatgaaagaggaatatagatactgggtagccggccttactttcagattttaataataactctgccattcaacagcaggttgacgttaagaaaatctcgcatgtcaatgacaccaaggaggcctccagaaccttctgaatacagtgccgtatgcaaccactgtcatcacctgtgcttggtgatgaatctcatttgccattccaagcctctgttacctcctgtgcttttgtttcctcctctttaaaataggcatattgaaaattcactgccttttatgattgtggtgaggataatatgattttatagttgtgaaggtcttttggaaaggcttagtatgctatgcaaatgtaatttttacaagactcatggcagccaatgggaattaagggctcactaaatgctattaatagtcactgctgaactccttatgtgcagaatttcatttaatttggggaatgagacattatgagtgtccccattttacaggtacagatattgagagacaaagaaatttgcacccaagttatctgcctcttgattccatgacatttgttctcaatcttaagtgtgcttaagaatcatagtaagcctgttaaaaatgtagatgtctaggatcagaaattagattctgctgcaggtggcctgcaaactacaattaatggctcagttctacctactctaaactcttaattatccagcaatgtggcaaagaacatgttcctcagacagagctcttcgggctcctgaattctactctgacttttccttgatcttctctggtagggagactatagctcttttgggtagaaaatgcccttttggcaagaaaaacttgccagttatttgggaggctttgtcttcttacatggaaaaaggtcactaatttctgaagctacctcctgtacagtagtatgagaatcctcagaggtaagaagacttgggccaataggtttgactttgttggttggattttcattattttccaaagagaaagtctttgaggccaagcataagggctgatttgccaatgggacttagtttccagtaagatcaagagtgtctaccacacacctgacttttgaactttcctcttagcccactaatagcagaggtgcaatgaggagatcttcatttggcaatggataggctcccaaaacagaaagcatggacatgccatttaaaggtcccaggagattgatttccaactggaatgcaggaagagtctaagagtaactgaaatttggaaacactgctagttatttttaagactactctttcttgaaatggatcagaaccaatagaacaaaccacaggttgtgatagatttatgcactgaggaatataggaagagaaagtaaaaactatgggcaaggattttcataaactgcatcataaattgatttggtgggccccaaggagaacataaacactatgcccaaggactcagggatttgacttttgtttagatccattttataggcaatctgtaaaaggaaaaaagggcaaaaataatattagttatctcataaagttgtttaaaaatcaagtgatgagaataatctatttaaaatacttatcacagtgcctacacataggaagctcgataaagttagctatgatgatgactgtaatgacgaggaggagcaggaggaggaaagggagaaagagaacgagagaggcaagaaatctgctaaggttttgctccatgaaatgtctttcagttgaaaattctcattgaaacagagaagctttgtctttataactagaagatgcagtttgaaaattgtatcatggaatgaaacacaaaatgtttttcattccatgaaagaattccataaaagagctagaccgtactccacgtggtgttctgcacatagaaggtgatcaaataaataactgattctgtgaagggctaaaggagattttcagaatgtgccatgcttctggggacaattggctttctgctatggtctcaatgctgatgtagaagataattctatgaaaagatcctcagaactgagaacttctgttttttccatgttaatgtttagatagccagaggacttatcattctaggtttgggggcagatattttgctatgcctttcctgttactgttagaaagaaaatccccacccctaccccgccactgtcacagtaataaagcactgctcaatgtgtctttagcacttcctgtccttgggaatctgcctactgcttctctaatatgggagagaccagcccctgtgctgaagcagtcagggactgtaattaccttaatacccagtaatggatcgttaggatcatgccacacagtccctatggtacaagagactcggaaattcaagatgggaagatgagaatatgtgaattgaatgacatgggtgagagtaaatttcccatcttttttctagtggaggaaatgcattaagtcttttgatactaaatatgatgttagctatagtttttgtttgtagataacttttatcagtttgaggagcttccccttttttcctgtgttgctgagagttttatcgtaaatttatgagtgctgaattttgtcatttttttctgcatcaattgaaatgattttatttttttaaattggttgatataaatatatcagttatatttatttttgaatattgaaccaaccttgcatctctaggataaagtgtacttggtcatgatgtattctactttttatatattgctgaatcttatttgctatgtgtattatggatttttgcatgcacattcatgaggaatattgtccagtacttttccttccttttcttgtaatgtatttgcctgtttttggtatcagtgtaatgctggtttcatggcaagtattcctaccccttcaattttctggaaaagtgtgtgtagaattgctatcattctttattaagtcattggttaaatttgtcattaaaaccatttgggcctggagttatcttcatgggccaatagtgaactctgcattcaatttctttaatagacatacaggccttcaggttattcacttcttctttagtcctaagctctttttttgaaaagatacattacacctccttcaaacctctactttaagttctggggtacatgtgcagaacatggaggtttgttacataggtatacgcgtgccatggtgttttgctgcacccatcaacccgtcacctacattaggtatttctcctaatgctatccctcccctactcccataccccccgacaggccctggtgtgtgatgttcccctccctgtgtccatgtgttctcattattcaacttccacttatgagtgagaacatgcacaaacctctacttttaatcattgtggccatcacataaccaaagtgttaattcacggcttgactatgaattcttctcataaccttctgggccttctgtttggtaaacagagaaagttagttcctttatacatttatttattcattcattcagcaaagattggaaccatattttgaattgtaggacatgcaatacaggttgtggtttcaaagatgagtcagacagtatccttgggttcaagtaaatttcttttaagagggagtaatagcaatcaaatgcttgactgtgctgcagtgggatatgtgtagtggttgtgtgatgggtagtgcacagaaagagaaaacaaggaaccattaattctgccaaggggaaatcagagaagtcttctaagaagaaatggcattttatttgggccttgaatgataaggagagttttatttggcaaagaggagtcttgtcatgtgaatcatcatgggaggtttggaggaacaagccatttcagcttttcctagggttagaacctttactttaggaatgcattgttttcttcttttgattgggaaaaccaaaatctgaatggtaaatttaaaagttacattgctttagttatcacagttcttctaattgtgtgtttctcagatgaatatgacatgcctcttacgatcttgctacagagtggattttatgttaaattatggcttcctggtgattctcagagttttatatcccatttttatttaaattattttcatagttgtaataacaaataaatttcttattcaaagaagatgcagcctttgaaatggatcttaatttgaatgttgacattccagtaacaaaacaaaaataaccacttgtagatggagagcgagagcgagagtgagagagagcgagagagagaatgaatcacaaacacctgtaaagtgtaactattagtttcaaataggatattattgaatctgtcctaaaaccagttgattgtgattattctaaattttaccttgagtatattgaccatgacaggccaacttcagttcctatatccggattcaactggattcattgcactttgattctaccatgaaaaacaatgcctttgtgtaaagtcatgagcacttctttcccttcttggttaactgtgtttagatctttatcatataagacctgactttatgttcattgttgaaattgttgctggtttcttttgctcttacacacccatgctggcctccaagaacaacttgctgtcattcaggagcttgcaaactcattgctttaattaattaacggaggctctttggaagttagggtcatttgtttttaattttcagttaaaggcacctatggatttctattttaagaatagacactgtctactttacttgcttattatactttgatactaaaatacagctataatggttctgcagcattgccagttatttaagtattcctgagtatttaggtaaaggctggatggcttggaactactctaacatggcaaaatatgtcatcaatgttttgctccaagagtatcctgtaatgtatatgctcaacttgagaaacaaaatatattataattttaggtttcaaagcataaatccttaacatatttactggttactacatgctgggcacagtgccaggctcttaagtgactgcagtagactgtagacagatcagacttcttgttctcatgaagcttggaatctagtgggatgctcattcattgacctatgaatacgtactgtgttatgtgccagacactgtgatagatcctgtgctttgccccacaggtcaaggcactaatatagtattatgtttggtacatagttggcccataactcacagtaaaattaacctttccattctctttaacatattacattattacatattaaggaagaatgtgaaaaaatgtaatcataatatcagagattgctttttgctcacaaaaatccacattttctcctgcttttggggtaccaagctagacttcatttcattctcctttgcagttaggagaggtcacatgagtgtgtcacactcgtgaaagatatggccacatgtgtgtattttagccaatgaaatgttcgtggaagggatgcgtggcagttcatgaccaaggcttttgagaaatggctgtgcctcttccacattctttccctttccactggcctgatgcaaatgagaggactcaataggagaaggcagagccacaaaaattacacctggaggaaattgcctgtattggccttttgagtaagaaagatgtaaacttctattgtgttgggccactgaaattttgggacttatttgttacagcagcttgtataatccttgttaatgcagtaacaggatagttataagatggctcattataaaaattatgacagattatcaaggcatattccaaaaaatattatcatttggcaatgataatacatgtcattcagaagctgaagtttctcattgtcaccttgcgggggtatattgacaaagattattattgccattcaaaatatgaacactggatctcacataagtcatgtgacctgccaaaatttgcaaacctgaactacagaggagctagtaccagcatctaggtattctgtttcttagttctatccacccaccccattatactacctccatgatatttatgtctaaaattattatagttgtttgtttctaaattttgtctgcttgctttccttgcctgtcttccaccagcagattatagtgtctgtgacctaagactttgctatgtgccaggcaatagccttgcatatcctcacacagggatacactgccgtatccctagctaccaggatattgcccagcacatcgtagactctcagtaaatagttgtgtcatgtaagaaagcatgagtccatgaccagaaaataacttttcaagtcaggcattttgtaatgcaaattaaacatgggtcttatgcatttttgtgaaagaaggagggaaggaaggaataaaagaaggatgcattatatatgtggaatatatgctcttgagggggttggaagaagaggaaggcagaggatgaaggcattgaggtggggagggacaaataatttcccattcttaactaattttttaaacaactgattgctgtttgcagaagatgcgttggcctaaaatgatcataatcttttgttagcttataatgcttaaataggtcacttaaataggactcttctaatagaagagaagcccattatacagattaataaaaattgatagagacttgaaaactgctcatggggtcagttatctccaattaaaagttcatatgccaagaaaaacaagcctcttcctcctaaattattactgtgaaaattttcaagcctacagaaaagttggaaaaatagtacattaaacatacatatattctctacctcagttcactgttaatattgggccatatttgccatttccctatatctctgagtctgcctgtgtattatatataccattttattttattctattttattttatctttcagatgaagtttcattcttgtcgcccaggctggagtgcagtggtgcgttctcggctcactgcaacctccgcctccccggctcaagcgattctcctgtctcagcctcccaagtagctggaaatacaggcatgtgccaccatgcccagctaattttgtatttttagtaaagatggagtttcttcatgttggccaggttggtctcaaattcctgacctcaggtgatccacctgccttggcctcccaaagtgctcggattacaggcatgagtcactgcacctggcatatagataccattttaaatgagacatttaaataaattacagacaccatcacacttcatccctcaatacttcggcatgggtctcctatacgtaagggcattttcctgtgaaacaataataccattatcatacctaagaaaattaatgttaagtcaccattgttacctaatatgtgcagtccatagtaacatttccccaattttcccaatggtgtctcttgtaactctttttgttttaatccagtatttaatcaaagtttatactttgcatttgatggttaaggcttttaagtcttttccaatctagggtgatggttctcaagggtgggccccagaccggcagtgtcacatcactggggtctccgggggtcgatccagcaatctttgttgaaagaagctctccaggtgattctgatgaaactgaagagcgattgatctagagcatgttcccacctttcctacttttcatgacatttcatttttatcaaaagcccaggtcaatttcattttagaatgtcccacattctgaatttttctgaacattccctcatggtttgattcaagtttaacattttggcaagcataggtgatattggcatatttactgcatcatgttatgaggcacgtgttatttaatgatcccttttccccttcttagtgatgctaagattgatcatttggctaacgtggttaccgccagatggatcccctctaaaggctatgttcccctttataattaataagtgacctaaagactgtgtgaatattttcttccccaataaactttcacccaatagttgtaacagccattgataatacttgcctgaattactatgttggtgcatggtaatttttctaattttgtcactccttctatattaattagctgtcattctttaaataagagctttctttcttcccttgcatctatttgtatttatatttgcttaaatattatgatggactcatacttattaaaaaatcaaatgtatcaaataattactatcatcattatttccgatattcaaatagtgccaaatttgttcacgagagagcttcttcaaacttctttctgtgctctttccctgctttctggcacaacaaaatgttctaggcttactgtgtacattccctgccccacaacatgaatcagccatttcttccagtagcccttgttattttggaaaccagtatgtggatgctagatgccctacacacgtgcatgacttgagcacatgtgtgcacacacacagtcatatgtgtatattttaatcataatttcttacagatccctccaattcaaatttgcagagctattgtcaccttcttcttatgcttatcctttctctctgtaggtcagaagtctgaccttggtcttcattgagctaaaattcaggtgccaatggggttgtacttctttctggaggcccaaaggaaaattttgttttcttgccttttccagcttctaaaggccatacatattccttgctcctggccccttcctccattttcagagccagtgacactgcaccgctctgacggcttttccatcgtcacatctgcctctctgatgacagtcttaaaagcttcttttttttaaaggagtgatgtgattagattgagcccacccagatagtccaggataatacccccatctgcaaagcctctcttgccatgtcacataacgtattcacaggttccagggattcaagtgtggacatcttgagttattctgcctacctacctcatcttccctcattcttagttttatttctcttctctctgaaaatcctgacttttaacaacctcagtatatttacacattttctctgttctacaatatacacaaaataatttgagaaggataatagcaataacaccaacaacaataagcctactaagttaaagctcaagatttctttgtagttttctgttacttagaatatattcaggcatgtagttgaagtactgtgttccaaaattactttaattaatttctttgtatagttgtactatagatttaatatacaattaggttcatttttttctgtttgtattcagacttagggttcacattttccatcctttccaatttattttatattttgagtgtgtaaactatatgatgataaagagacatattcagagaagtccctgtcccatccatatcccctttaccctatttctacccaccagctacacattgtcattcttagtctctggtttatccttcccacattctttttggaaagcatagatggacatgtgtatatgggtttttttttaaccttgtttttacttctttcttaccaaaaagtagctgagtttattgattttatttttgcttgttgcatttttacttaacaggatatcttgcatatatatgtatatatatatgtatatacatatttatatagttatatatgtatatatatatgtatatacatatttatatacagttatatatatgtatatatatatacacacacacacacacacatatacagtatatcctgggaatcactctatattaggtagtcatggaaatcttgaaaggagtaattattaaattcttaaatacgtcttctggattgtttaacttgttacaactctgtataatatttgtgacttaacacaactataaaaaggcaggcattgaaagaaaatgtcttgtatgccttctgcccacctcttccctccctgaggcagagctaatttttttcctgtgtttgcataacattttgtatattaaagtattatagcaacttttattatagttatttttatttgacaaaccatctccctttctggcctgctagttccacaaatgtacaaagaatttctctctttccttttcttttttctttctttttagaggtgggagtgagtagcaatgattatgcctggcatatggtgtttctccatttacttattttgcctgaaattccattagagatttagtcagttggtctatttttataatagcgtctattttaaaaaaggtataacatcctaatatgtattaacttatcagagactagccacttcttagaaaagctatgaaaggtcagatgagaaaaaaggacagtggtgtttggattctgtctctgatagaaaccccaaggaaggcaaggaagagtacaagggttgtagatactctaggaagaagagaggatgaatcaaggaaaggaaaagaggagacagaaagagaaggtctgtatcatgatgtccactatgtgaggtactcacagcacaggaaatctgcctagatgataataggagtgatgttcattaggaaagaaatagccccaaggagttttttctttacatgctaagaagctgaggcccagagagatggaacaggtttcccagggcaatagcactaggaactggagctgcaaacttttgagtccaccatatccaccctgagttgaggtgatctttcttatgatcctgagagggaacctttgaaatcaagcaggcacccctacttccccaggggtgggcagagggcctgagcaatccctccttttagagcactttgcagctgggccactcatctcaagattggaatgtgccatctccatctttcctgacctccttcagtcaagtcagctgtatttgtggaggtgcattgttcagtctcagagcattgtttaaatttaaaatcaatagagaaaagtgtgccagcgagaggcacagactgattaagtgctgtctatatgaagaggtttatcctctgccacatttctgttgaaagcctgtgaaacatgaataggatggagcaaagtgaaaacacattaaaaattatgtcagatacccaaatgcagtaaagcaactgcatctctgacaggtaatcaagaattgggtgactctgagttctgatttggcgtaatgatatcaacatgttcacacacacacacacacacacattccttgtatacacataacacacatacaagatacacacacgaagtagacacacaacatgtagtatgtgtattgtataacacaacttacataaagacacacagaagacacacacaacacacatacaaacacctacatgcccatattcaacacacatgcacgcaaaacatgcaacacacattagtgcctgcacacatgtgcacatgtgcacacattgagcaacacaataaagatgtaacttttccatctcccaattcattctacatttttattttgatgaaaagatagcagtagagggggaaatctcttcatcagaaaatacagtgaaaaaattcccaagacattgtcacgtattactggttatttttggtggtgaagagaattatttgaaaacaaagaagcctttcacaaagcctctaaaatacaaaagatttaataacatttacatctgtgtatcagccatgtctgtaatgcgagtcatgaataacacataaaccagagcacggaaagaacagaagtgctcacacatcatttaaaatccaacccaccccatcgtcggtggaatcaaatacacagcaggggcagttccagttgctacacacacaatagagtcattggaaatgaaaacatattaattatgttccttaaggttaggagagaaatagcaggattcactaaacctttctaacttctctgttgaaaatttgtaccaaagagtacatcctgggttgcctctttatttttcctaagaaactgcagaatgagcatgtgtatttgttttgttttactgtttattcgagtctgcacttggggctcagacttgcctcattgttgtactgaaaatggaagaaagttggcttgggaagatggatctttgttacgagtgaataacttgcagaaaaattacttgttttaaatgcttgacaatacctgcacaagtcccagtggtatatgtggaaattcttgctgctatgaaatgagtcatatagtatccagtcctagcacccatggagcaacatgtttgaccatgaaggaaatcattccttagtctgatttggataactgtccgtggcccaaatttggaattgtatgttcctaggtccattcatttggctcctatgtatatccagggtatccagggatcttctaggctggtgagagatcatcaaactctgctaggaggcaacctctagtgccctaatagagaagggtgaagccgggaatgctggctcacgcctgtaatccaagcactttgggaggccgagttgggtgggttacttgaggtcaggaggtcgagtccagcctagccaacatgccaaaacctcatctctactaaaaataccaaaattagccaggcatgggggcacatgcctgtgatcccagctacttgggaggccaaggcaggagaatcacttgaacccaggaagtggaggctgcagtgagcccagatcgccccaccgctccagccagggcgacaggatgagattccatcttaaaaaagagaaggataagttcagggaaaattgaactgatgatttttgggtgagttcatatttattctttaagtcagtattgtgtttttgtttccaggggtaagaagatgttcacataatgctaatgttagattagcacattttgtttgcaggcttttgttttggcatttatttctccttcttcctctgctcactatttccccttctactgctaggcttccttctgatggtgtcagaacacggcatgccagtccagagtagtttaaaacgagctctgtaaatgtcatggaacccctgcctctgcctcccctatgtgtctcatttcagtgtaaaatttcaagcacttccctgtccttacgccgcaaaaggttaatagtcatcttttttttatgtactgtaaatgctcaattcctaaggatagtgtttcagggcaagttgagtgtaattgctaaataatatagtaattctctttttaaatgagtcatacttgcgttgttccagatgctcctgcatgcatgtgtgtgcatgtatacatgcatgcatgtaggtgtgtgcacgtgtgtgtgtgtgtgtgtgtgtgtgtaggcaggcatgagtgaggcctccccttgggggaagtcacagccatctcataggagtttgcacattttcacatttgggttttaaatgttgtgccacatcctgggcttttaggtgctgcggattatgtataatagatgacctgcatttacagagatgtgtgctatacagatgtaaatgttattatagcttttatattttatgttcttgttgaaagatcattttgtctttgaataatatggccgctcaattttttttggaggggagggggttatctttaaaagagaatatgaaatggatattgcacatcatatatttcttaaaagtaatttggaattttagggtctgggattggggctgactgatacactgccgtgatgagatataacccctggaaaataacagcacccgcacatgcctgcatctgtctaacctcataattcactttcacattggattatggatgtctgcgttcagtgagtctatcttccctttaggtattatttcagccctttgagataataaggaaagtttaattgcgttgttaattgattttttgcacaacattattaccttgattgattgcagagttgatgaaaatgttagacacaggcagcgtggagtatcagccaggcaaggagtgggagccttgtggagaatagataaccttgatgttaagagctatatccttcagatatgtcttcccttgacatattgatggcccctgaaaagggaaaagctgattgtatgcagaatgcaatcattaaacccacttcagctcactgttgattaatttgttttttcctgaaggatctagttatagggaaggcctcacttgtaccaaccacagccattttccaggttccagactgtgcttaaccctctaggtgaagggaagtgaggaggctggcttgcctgagacgggaagattatcttagggtgcgcagggtgtgtgcttaaggctcacaaggtgtctccatgctcgggaacactctatgtccttcaccatagtgctgattttccttaaattattgattctttaaaatgccaatagcaaggaacccttcactgagacctggtgtaggatgaaactgtcacttggagattctcaggaaggtgttcaccagtccagtggtgtcgggagagacatggcactcaggagcttttattatacattaggtaaaaccctgcatgagattgcccccatgattggagaatttagttgttattggggtgtgcctgtgtgtgtgtgtgtgtgtgtgtgtgtgtgtgtgtgtgtgtgtgtagagagtgatgataagaagggatttctgcagacagtttcttatattgtcaattactcctctccctggccttatatgacactttcttagaaaagtttattgaaagccatcatcattttttctgagtccagggccatcttcatggtagcaaaaatcaggttgattgatcagttggtttactgattgattaataggacttctgtcctgtttccctcccctcaactcacaccacttcattcgcaactgcccaaccctgcacagagactcagtgggctgaatttatgggcaaagaagttgcccctctggaagaatgcaagctcttatacatgcagtactcctagagagcctcatcttctagggagaacggattgctacttctgccaccccctcgccagcttccatgcttattactcatggaacattctggcttattttgccctcttctttcctttgtggctgtgcccaatgttcattcaaataaaatttcaattgtatagcattgctggaggcctaccaatagttacatcagcttcctggagtcctgagccccccccaggagaggtcatgtgggcttctccctgcaccacagagcaccctgtagacggaattctctgtgtgatgctaagcacagtttctcctcaggctgccccaccgcctgcattatgagtctttcttctcctgaactcaccactggtgctcagggagtctaatatccatagagtcttggccctcaattaccgtaatggcttataatgagattttggccaagtagcaggtagcaggttattacttcctgctcagcgtgggcaatgtctacgctgttaatttgtgttgccgaatgtggcttagagctgggcatcaaactgtcggagccagatgtattctattaggtgcgaggctcacattggcccatgggcaattttttccccccaatatggaagcatgttaacttaccacagggtgaatcctgacaaattcaagccagccaaataaaaggggtaatatcccaagccatcaaagtagtacattctagggacagataacacctggtaccacccactgtcagcagtgtctgtctgactggggcattctattgataggcaaaaaacacacccatcttaatattgctggagaggctctggtgccttcattaagttttaatgagcctgaccctaatgaaagcccttataacatgctcttctactattttccttgtctttatcttgggtagaaaaaaatgtacagaggttcatataactcttataacctgctttctactattaattcttccttaacctacagtttcttgcattaacatatacatacacatatacatttacatatatacatgcacacacacacacacacacacacacacacacacacacacacacagctttttcccaaagcaggttagaggatgggaagttgaagatcaggaaattatgaacatattttaccatttggcactgggatgagctagtgtccaagaattatgctgtgctttctgcaacaacagactgggtcattttttgtaaagcaaacttctttcggttagattatatatcatcagattccctttgttttcttttcagagaaagcaatttagggtgtgctggaattaggaaagattatggtgatatcagtacaggaagagtttgtttggattctaatgaagagcaggtggaggctggaccaatgggcccaagtaaggaaggccttttccccaatccttgcagggtttgaattatgacaaacccagttgttacagggtctgcttaattttatttgaaaggtttctttttttttgttttttattttgtttttttttttttgtagcttgaagaattaggaaaacaagaaagcaaattgtctttattttcagtgactctcttgagaaatttcagcctgcagaaccagacagaactgtggatgttccctgcttttgatgtaagctctctaataggaacagatctgaagcccaaaagcaaatttctgcttgagagcaaagccaaaattcccattcagactctgcaggaggacccccactgctcagatttcttcatacaagattctgtcagttttggggaagtccaaagtctttctgtgaaatttttcctgcaagttattttttgattatactccataaatgatggttcagatctattctacatatccaaagaaactgttttcttcttttttcctgttaatgtaattgcacattactaaaatttgaatgtttatggtttttgttttagataaagagctggaacaaccttttattattattattattattattattattattattgttattatttaggtatcattagctttcagactgctattggggataaaataaaacctccatttaccaaaactcaagacactagaaccctcagttaaccagatttttggatctctgattttagacagtcttgattttacaagagtaaaaagcaatgtcacgagttttactttttaaaaagaaataagggcccctctgtaggttgtcctaaaacagtgtttcttaaagttggtccctcagcatcggcatcacctgggaacttgcaaaaatgcatactcttggccccaactcagatccatggaatcagaaactctggggaacggggcttggcaagctgtgttttaacaggccttctcagtgattctgatgcatgggcaagtcatagaaccactgtcccagggccaacccatacatttctacctataactgtccagggatgtataataaatgctggggttcagaataagtatgctgagatcttttcatctattccacaatttaaaaacaatgtactgcatacctactgtgcccttggctttatgatgcatgggcgaaagtctattgttttcgattttttggagctcatatgagcaggagatcctaagatcttgagaaatgttcaatctgcagtcttcccaccccagctaatctcctaactgtactatcctcactaaaggcactccagaaatactcagttgtggtcactatgattacctagtaagacagtgaaactgactttgcttttagtgtcttatgtgtgaaaattcaaaaaggtttctagctaaccatgagttaatgagataatttaattaacaaggacccaacattctccgagtggctagttagtcacatgactgttatattaggaaagctaagaagatgtgtgagggccattttatacttgcctcactgaccacttgagaggcctctcggctgaaatggagaataacacctggacccagctctggtttcccctgcctagaaggccagtaactccaatttgtgtttactccttccctgattgaatccactcatgtatttttatcctataaaattctaatttaaaatgccattccctagaatgttatacctttattgctgtttgtttgtttgtttgttttttaataatgatatgtttgaaatatctagaagcccacaaatacctctttctcctaaagggaggtgatcatctgttgttccaggtatgaaaatagttacttgacccatgtaccagagaccaatgatggggatcagatgaggatcaaacagcagctggaattattgtcatatttttatctgagtagcttctgcctctcttttttgatgacactgagaccaggtaccctgagagggaagacaatgctaggtagatttgtggggagggggagcattaaaagaggataactttgtgtgtattgatccatttttcatttttatttatttttacgttttttacttttttgactgtcaaatgatggcatatctttttgaactttcatggtaaaaatgatgttttccacctaagaaatgcaggaaatctttagtattttgaatgcttctttacatttgtggaggtgatatgcaaaaatccccaatctctgagcctggaagattaattagaacaattgatggtaaagaaattcagtccctgaaattgaggcaagaagaaccccaaaatggggggcaaggagtgtctgatagccccattcctgaaaaccttcagcacagattgaccaaacatgacatactgatcattaaggaacctataattggtgaccaaaagcacagtgtggctataatggctctccctgaatagttgccgccatttatttatttatttatttattttaagcaagcggctgctttcctaacttcatgctgccctctagtggtgatgctcccgacttcagctagaaggtggaaaggatgaatgtagagataatggcgggaatggaggaggtggtgacggggtggctttttcctttctttcttttttctctcctgtctgaaagatgtctgagtttctcactcaaacattgagaaagaaacgtgaggccagagcacttgaccactgtccgctttgactgacagcctggttgatgtgacatccatcacggacccgcactgaagggcacttcacaaatctgaagggattcgcatcccatctcggcatgcactttggaatccagcccatctcaaatccattaagccctacctagaatacagacataggagagaagggaaatacactcacaccaaactagtcttgcagttcaagtttctctctaagaaaaagcaagtaagaatgagcctgctaagtaagggtgtgggtgatctttgatgttctccggagacccctggttcctgtgaacaggactgaacaaataaataatgaatttgaaaagtaagcggaaaagcaaaatttatattcctgtcgccaaggcagtatcttataattcagggatatttctgggctagatagagttgtatgggtgcctggtccggttctgtcactttccaaaagccagttggaaccttatttttctccgctgtaaaatgaaagaatttacctaaaatgaggttctttaaattctttctcagcttgagaatcctccaatacagttaaagaaatacttacaaagaaaagtttaccattctgtattgaagcatactaggcagtacagcaaatcacagagaatccttataggacagtataagcaattcattgtttaggaagtcaagaataaaaactgtttcaggcttcatctttggcttggaccaaaaaaaaaaaaaaaaatgtaacctgaggctaaaaaacaaaatttggactgctaagaagatttagcagtttatttgggggctggggaggagaggggttgttggagtaaggaaatatttaccatggagtttgacctctcatatttataatacatttctgtttgattgaaatacaatgtgtatagaggtaggagccaaaaaagggagctcccaataaagggggctagtgagcccaccctccaatctgagaatctttctgtcagttggtactcacttgttactacccccaatccaaaaaaataggaaattaaaaggcattgacatctaagcaaaagtacattgtctgtttcctttccaggattcacataatggaaatattccctgccagataatgtttaatctgttagcctaatatttctttcatgtggaaaggactgaatggcccactcagtctggatagagccacaacgcctgtaacctgagtgtggggtccaggacccaagatgggagagtagagaatgtcactaaggatctgctcaaagatgcagtaatttctcagacttggaccagcttttccattttccactgacagattatatgacagactatatgaggaacttgccctgcatttttttctcctctctttccttccccacctccccttcttcttctaagatgacaagcctcatttcagctgccctgggagcccagggtatgttttcttgaggctctggtttgtcacacgacaatgagcctgcccactctgtgactacctgtgtagcctccctggtctgggaggctagccccacagccttgcctgctgatcaccttcacgacaaattttgccagtatcccttccctgctgactgacttccttcccctgtttttccttccctacaaacaagtgggtgagacttgacaaggcccagcatttgtctgagcaggctgtataatctgtcctctcccagtggaaagctgcactggacgggtctgagcattggagtcaaatgccctcttgtcaaaaggataggttgcctggcatttttgctagctttctttccaggtatggtgcatcctaacccttgaattggtgctccacactctaatattttgtctggcatttggtagaagacagcatatcagaaccccacagtttagaccctatcatgcacttggtattcacctttgtccttcatactctttgtgctaagaaatgaataaaaactagtgtttactctactttatgataacaatgttggtagaaataatcaacctgggaaaaaaaggacagcaactaatcctgcacgtaatataatttatgatgaatgaaaaactgaccaaagatttatatcttgttgatatattgaaaaccacacaaatacatggggaggaattaaccttggtagaaataatgaaaacaaaataaaattgaaatgagctaaaactacacacaataaaatttgttgactaaagtttaagagcagactcaagtcttcttgtcgcaatttagatctgcaatattttactcaagaaaatgggactttgtaaaaataaatgactctaaaagagatttagaagatgtaatcagcacaatttaatatttggccagagctgattgaggaatttaaccttactgtaaaaattacgtgataaagaattgatcccattgaaaataaactcaataaaatagaaatgaaaatgttaaaaatagaaatggttttttgtatttaaaaattgattaaggaattaaattggctaaatggagtttgctgtgaataattaatgctttctcaaagacaaattaccagactagtttacatgtttgtatttataaacctgaagtcaaagcattcctggactcaaatttggagaattcaaatgtctaccaatgcaagacatcagggtcagtgtagcagggtaggaataccccttgtggtgttgtttttgtacagtgaaggtgaaacaggaagcatggtttgaagtggtcactgcggtatttagcaaggacagtgtgcagtatccccgcccccaaccccccacccccggcccccatggtgcaagagccctaacagaggttttgggggttatagcatgcactgttgcgatgcagtaccccattcccacccaatatgcagatgataaaccgagacacttgcctgaagtcctgctcagctaggttgggaaacaagtctcacactttttttttccttctccaccctcccctgggtaaggtgtagagcctttcttcatttcatctccaacctaaggcatctcagatgtgcggcagatgaagggaaaatatactgggtggagaagaaggtctttgtcctccttcctcaaaaactgcttccacacaatcccttcccctaagaccttttaaagtctctcttctttattctgtcttagtatttaagtagcttacactgaagtaggatgttgtgctaggagcctgtcatttctcaggctccactaaatcctgtgtgatagccacagcagagctgatagcacatcacatgggctgacctcagggtattgctccagctacttctcaagatcataaaacatgggtgtttattcctttccagttccccatgtattcacggcctgcacttaacaaagactgaggaatgtgctttctggggaatgtcccttcccactgtatgatgtttacagctctttaggccagatgataatgttcactgcacttctctcttttcaactagatgttgtgattgctttgtttttgtgggaggaaagtgtttggggtaaaaacaccaccacgatttaggaactgtggctgttgcctcctattactctttgttgttcaatggggcaaatatttaatccgtatatattttcagagtgtttcaaatgtctgaagtcataccagaggttaaaagatgagtgtccagcaattgacattccttactttgtggattctgtgtaaattttatgtacatgattattttaatggtattaatttatttaacaaatatttattgaacatctcatctgtaccaagtgcagatgctctccaacttacgaaggttcaacctataattgtttaaccttacaaagccgtacacatttgatagaagatgtaaccccattgtaagttgaagggcttacaacttcagatagtttcaagtaatgatgcatttttgatttacaataatttcaacttacaataggtttattgggatgtagctccatggtaaacaagatgcttctgtatggttttaggtaccgggtgttagaaattggggaggagggagaatattataggggatgacacatttatggacatgtatagagtcccatggaaacattgttctagagccttctgcagtggaccaagacgctcctgatcaccttttcctctctgtcactgggcccatctacctcttcacaacattgttatcaccttttgcaggggtcaggaggtacctagttccttcgtttctcatacagatgagagaacaggagttctgtgggggaacccttcatcccctgcctccatcctaggggtaattataaactcctagtatcacaatgggatcaagatatgtttgtgatttcatagctacatttataaactcatatgaaatgcatttaaaataatgatccctaaagtgatgactaccaaaactaacaatagtgataattattctattttacaaatataaatgtgttggtccaacctgcactccaatgtcaaatgcatttttgtatttttatatgcagattgtttttcaccactaaaatattaatgacagaccacttgctttgatggctgggctttagttctgttgaatacggagttatgagacttgggcttatgccaaagccagtgggatacagcttagttagtggtcagcacttctagctgtatgaaatgcagattgcaggaaagttaatgaaaaccctttcctcaaggattttggggtcccccagaggcccccttctatccaggttatactgtggggttacaggctggatgggtttcaagggctgacttagtccaaatcaatttttttattgactgacctgttgaatttgtctcctgcatcaggcaatattggacctggtgttctcatcttcataaggaaaacattggaaaatgccaaatcacctatttcagagctaaaatgaacctctgagattatctggccccttgcccttgttttacaaatggggaaacctgcccagtgagagaaagggatgtgtacatggtcacatgactgttggggcagggctggatctaaatgcaggtcttcccccacttccccttactaaatagactattgaactgcagctggaagtgtgaggccatccaggaatcagggagtccaggatgctggatgaatggatgtgcaagaattcccttccctggactgggctctcagggcctcccccagcaaaatctctggtactgaccctgcagtcccagcctcacatccaagaaaggaggctgattcccacccacttaggcagccccaaggttataacttaacctgcataattaggatgtccattccagaggggaaaaacatggaaaagataaagggcctctttaaaacagattcttcctgatacttttttttcataattatagctttaacagcttatggtgatgggaaagctggctacttaagaaaaattaggagtctcatttggcaggagagaattccccaggggatgttgccctgtcatttttcagggtctttcgaaaagaaaccccacacagacagctgcacgtcagcctgacacagggcaagcctgctttacttactatggccaaagccagatcttttaattaaaaacactgcatatgccattaaatgtgttgttccccctccagtcccaagaagttgtagtttgaagagatagaaacaaatgaatccgttgcagatgtgtagagaaaccattgcctactgagtcacaaaccagcgggttcccaaattccagcctcggagtgcctccccatcaaaatgttctttgcaagcaaactgttccctccgtaattttcacagttgatggcagttgccatggcgggagaagaagggctgtggggaggacgagggagagagaaacacaatgccacctcacttaatttacgagcagagcctcatattttacaaataaccttcatgataaataaaggcctgtggccacacatgggactgtgctgtttcgtgcatgtttgcttttcctggttaattttatttatttatttttgaacacaaaagtcacatattgggggtaatcacatcccaactctgagctctgggaggagactcacagaggcaattctcgcttaatttcagctgctggagatggtttgagtttgacaatttcagccgattcttagcattgctagccagagcacctttctccccgggcgagcaccagcagctggatctcattttcaactgccaggccgtccccacgccttcctggagcagcccacagactgagtgccgtcctttctgggagtttattcaaggtgacagctcctcacacaatggccttctgatcacctcaagtagccaagatatcagtggggtcgggcgtgctcctcctgcaaattccaaatttagattgactgaggttatccttaggccccttgaccccaccactccagcagaacagaactgccaggacctttgcagccacagtgagttttgtaatgatgtctggggagagatgttctgcaggggcaggcagagacgaccccaagtgatggggagtgatgtcagctttcgttagagccgcaggcagcgttagaatatccttggcataatatggcgctggtatctctgtcagtatctctgttttctgtcaccgcacacaatcctgggcctgtctgcaaccctgatggtgtcttttcagatcaggctgttgccagcacagagactagctcggctcttcaccacacagcccctttgtttgaagtctgcccttttgtcgttaatgcacttgatgtctatttaaatctgacagtgaatgcagtatctgttttcctgtcaagagatcattgacaatattaatacctcatgtccttgcctcattttccaagtgctgacacctagccgcagtctcctgcattcatcaaacagccttctctcaccaggatgtctataaacattcttgcttccaggcccaaagaaacagggtaggccttaaaaaggacttttatcaatgccagccagaaagaaggctcgggaatgtggcacagaacacatcccagcccacgttccaggagcatccagcctgtttctagggcggcacttgccattcaagttgcatgtaagtgagatctggagtcgaagtttaccctggagaaagggaagaaaaaaaaagcagttgaatccgtgaatgtactggagagtttactggagagagggcactcatggtgggtggtgtgtgtgtgtgtgtgtgtgtgtgtggtgtgtgtgtgtgtttgcctttcatccttttgcttaagagaaagattgtgttctttatgacatccgacagacctatctgttcctttttattaaaattcatgttatcctagtgccatagaaataaattagcatcctttggccccatgcttccacattcttcagggtttatttgaatcaattatgtttaaggaagccctctgtggatacctggcagaactgaggcactcccacccaggcctgtagtggatgctattcctggagcagagcctgatcagccaagcccacagaccagcaggatcctggcatgggtgacaatattagtacaatgctgatggctacataattcagcacgataaaggaaacagctcaatgccaacaactaaaagaataatttaggtcccaagaagggtctcagtgaggttccatccaagctcaaagtttccaggcaccagaccaatactgaaaaccagaaattggggattaggggccaaggagaaagcatgaccaaggaggaggaatgagccacagtaaacttactcatgggaacatggcaggaagtaaaactaatgagagtgagcccaaggccagctttgaggccgtggaacaatgtcaccctctctccattgccaactctgatagactatttgaccccagcaatttctagctttgttccaagccatccaaaccagggagcatctgctctgtccttaaaagtttctaaaagtcattttgatccttatgtaagaataaggtttgaagttttgtagtggagaaacatctcttttacagttgcaaaaatatttactacttagaacttctgatgtgaagaacctggttaatttcaagtgctaatttatcacaaattaaccaaaaaaaaaaaaaaaaaaaaaatgggcttgttggtttcacactatcacactgatggaaaaaaaaatcatcatgtccctaggtagctattttcacaggcagatttgtggctattgaatgactgtcttatggacatttcctttctttgtttttttctagttgtgtacagttcagagactcaagtccgattagcgctaagacaactctgtccaactgaatttaaaataggtttttctaaaaatagaagaaaataaaaatgcaggtggcaaaaacaaaacagatttttccttgataatcctacagagctttcataataactatggaagtgatttcttatgggcatttagaataaataatgagttgattaaaaagttcaaccctattgtaggggcatttttcattgttaagtctcctacaatctccttgaatgagaggagagccttatacggagccacagagttacttaaagtaaaactgaaaatggaaatcaaatgcattctgaccagagaaagagagttcaggattcctgtaagaagccatttaatgggaggctcttgttcctgtccatgtggtgtttttttttgtttttgtttttttgtttttttgagacggtgtctctccctgtcgcccaggctggagtgcactggcgcgatctcggctcactgcaagctccacctcccgggttcacgccattctcctgcctcagcctcccgagtagctgggactacaggcacctgccaccacgcccagctaatttttttaatatttttagtagagacggagtttcatcatgttagacaagatggtctcgatctcctgaccttgtgatccacctgcctcggcctcccaaagtgctgggattacaggcgtgagccaccacgcccggccattcatatggtattttgtcaacaccacctctcttccttaatcatcccatatgtgctcaatgcctggtgcctgccagaatttggaatattctctctggaagtcaacaacattgcttcatgataaagggtatcaaaatagtcacattctgggaagattgttctacatcttttacttgggctgggttcatctttaaactcttaattttccattctttgaaactctactaagggaaactggcgtgaggagaggctacattctggggagtaattggccaaattagaaaagtacctagcatgtggaagagaagtcatgcagaaagtgatattcctaggagcctatacttgtagtgacattttatttcaatgtcaactctgaggttgacagaatcttcttgtctgtgaggacaaaaagggagagttcttcccttctggagcttcatccactttctgctgcccattggatctatgattatcttgcatgtctgcttttcagcacctgtgtttccctgctatgctaagtgtgccacctgtaatgatgtgtgtctttttatttgcaggtgtcctggggaagtgtcgctacgtttactatgggaaaaactcagagggcaacaggtttatccgagatgaccagctctgaagccaacttctgtataccttcacccatttcatgaaaataaaatcaaaagggaaatcaaaaataaagaaaacgctaaagaa

SEQ ID NO: 997 - DNA, 1120 bp, Homo sapiens
ctcagaagaccgagaggacagactgccgtgttgccaccacaggtaagcccttggccgccgggactgccctgaactcaggggcactgcagggtcagcccccttctctcccatctctcagcctccccgaccccattcccagctccatcccaggaccaatgccaccaggggagggggaggatccctggcaggggtggcagctgggagacaccggcccttgctgcttgctcacacttggctcacacccatgacactagccttgcacacacatttggaggtgatggcaccccggcactgatgccttggggatgctgagcttggacgaggcacgctgctcctggtgggggctttcctgggccgcaggctcgtgggcagccatcccactccactgagttcatgtctgtcttctctgcccacccctgcaggctggaccatggacccccaagagatggtcgtcaagaacccatatgcccacatcagcatcccccgggctcacctgcggcctgacctggggcagcagttagaggtggcttccacctgttcctcatcctcggagatgcagcccctgccagtggggccctgtgccccagagccaacccacctcttgcagccgaccgaggtcccagggcccaagggcgccaagggtaaccagggggctgcccccatccagaaccagcaggcctggcagcagcctggcaacccctacagcagcagtcagcgccaggccggactgacctacgctggccctccgcccgcggggcgcggggatgacatcgcccaccactgctgctgctgcccctgctgccactgctgccactgcccccccttctgccgctgccacagctgctgctgctgtgtcatctcctagcccagcccaccctgccagggccaggacccagacttcagcaaatgtggctcacacagtgccgggacatgccgggacatgcggggtggctgttgtcatgggcgtctgccccttcacaccaggcactggggctcagacccaccaggaaggtggccgttcagcccgagctcctgaaacggaatcccaggtcctggctggagagggacacccctgattaccttaaggcccaggcaataaagcagggtgatcttcctccca

SEQ ID NO: 998 - DNA, 1069 bp, Homo sapiens
aaactttggcaaagagttttaatggcaaagttggctgcagcgacaatgccactcggggtggggccggaagccatggtggggaaggaagggtcagcgggcggcagggcagggccgggtccctgaagaagcagcgagcgaggctcagcgggcagtggcgggcaggcaggcgctactacatgatggagcaggcggacagtgggttccgcacgtggcaggtgcacgcggccccacagtactgccggaaggtctggtagcagctgccctcgggctcagccccccactgacccccggatggggccgtcagcgcctcaggcggcaggcggctcaggatggacgtgttgacagccagcgcggccaggccgtagtcggtgaagagcacagtctcacggcggcaggtggggcaggagatgaacttgtacttggggcaggactcgtagagaatctgcaggcactgctcacacacagagtgcaggcaggacagcacgcggggcctccgctgggtgacattgtaggagtgcccacaggtggggcactccaggggctcgcctgccgccgccgaagaagccgccgaggccgaggggccaggccgaatcacgtactgattcacaatgacctcatcctctggggccacgcggggaaagcccagctccgagcttcccttacggggccgccgtggcagtggcggggtatggggtgccccttccaaggcaggcatgtcccccccacaggcctggttgacaatgatctctgtgtctgagggccaggcacgcttgggtgccagagttggggtgggccggggagcaggcgggaagcagggggcagccggtagctcagggaacttttcagggtggacaatcttcatggcctccatcttgaggatgacatggggacccttcaggcaggacatgaggaggcccggccagccactgcccgcctcgggcccggggtcagagggcatccggctgtctccagtcagactggatgttcgggtgggtgggggcgttgtgtggggctggggggcaggtgacagggcagcatcctggtcccgccaggcctggggggggccccg

SEQ ID NO: 999 - DNA, 682643 bp, Homo sapiens
ggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccagcttattgctagcgtgggatagagggagcgcacgcggctaggctccagcagcgactcggcttttcgcgtattctaagcactgaagagcctcttaaggggagctgtccaaatcgcccaggagtggtggcgagacacaggaggccatgccagcgatgctgttattaatattgcagacttggtcatctctcctggcttgcggtttcttttctcctcttccctccccttctcttttctctcacatgtgtttcacacaggtggtggggattactcaatgacttacagctcccttctcgtttattagtgggagggggttgaatgttggcagttcttacaaagcatttgttttcttaaacgatcctgtttgatccatactctgagataagtatgaaaatattaaaacatcatacgttccttccttttataccccttcctcctaatccccagcacacatcagaatgtaaacattggttagcagatatagaaaaataatttcagaacgggaacatggattgaacatcctctttcaggctgacagcccttaaatttcattaacaagccgccgagcctctctactgctctgggaatgatgctaccagtaagaaagattagccaggtgagagtccccacatgaaatctttgctcactaacctgtgacaccagctggttacttgaggcgctgcaaacagttcagtgatggtggaagtgggatgcagaagcagagcagagcagagcacacaggagctgaaaatgtatgtgtagatagtggacacgctgtctatacacaacaaatccccttgtcaggattaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaactatacaagtaaatcacagctctgctaattttagttaatatcacgctactgatctaaataatataaaagaacaagatagatcctcataaatttataggagctttttttgatctttgtatcatttgtctctgatgacgagactctcaacgtttgttaaatgagtatatatatatttttaatggtcaatcagacaaggtttagagtttgttcacatttccaccaggtggcacccttctgctgactccagtgggtaaaaatattgcctaaaaagcgtggctgttctctcagctccaaaagcaaaacaaaaataaccacacaaaaacaaaaacaacaaaaacaaaaccatcccactttttagagtatgactaaaaagcatatttttaaaagcaactatttgactacaaagacagcacttgttatgcattttctttaaaaaaatgcattttggtaaaaaaccaatctcttacaattgaacgtgaagctgtcacttgatgaaataattcatgaccagaattgagatcaaatgtgtaatgtgtaaaatgccttctctgaaatatcgatgtgctttagacatttaggtaatatcaacttaaaatgttttaatacagaaattggtattcagtatttttattttacctttggtctagcaaaccagattaaatattcaaacatatgcttaatgaaaaattgcaaaagagttattcttccatgtgccctttgctaatatatacacatcataatttgatcaataaactattgtttttaaaacacaaccatgaaaagagctttcataaatcatattgaaaaattttaattaataaaaaacatattacttcgaattattcaacatataaaatgtcatatttaattgggagtagagttctatataatttggttataaaagataatatacattaaataaagatgttatatggaagtctatgatttgagagaaaatatgcatttcctactctccctgaatttcttatttttatatgtaaatattatatattatataaatttataatataaatatatatataaatttataatataaatatatattatataaatttataatataaatattatatataaggcattttgtttattaagaacatacaacaaatatctcttgcttagaatcttctaatatatctatatatctgtttgattatttcaggatctgagcaaatggtacattttaaaaagattaaattatataaaacaacttaaagaaaattgtattattaaatatcaatgctgcattatcttatgaagcacattacattggaaacaaaacaaccaaatttctcccagtctcagtaaaaataaagcaaattcaaaattttggtttcttgaattatttatgattacagaatgtcttaagctttactacttataggcacattttaaatttacttacagtgtgacatgtagcagacacaatgccagaatgctgtgactaagattgtgagattttgtgctatcaacaacaaatatttattcatcactgtctatgggttatgcactggaagtcacagagtcaagttcatatcccaggtccgccaaagaccagtgtgttttcttgggcaggataactgaatttccccatttcacctgtgaatggaggtgactgcagttccctttagatgtttgttctaacggttaaatgaaataatatgtaggagtttttgaataaggtctgactcataccaagtcttcttattaaatgtgtagtctgggaataagagcctagacaaaatagaaaaaaaaaaaaaaatctgggcctggtgcagtggctcccacttgtaatcccaacactttgggaggctgagatagatggattgagcctaggagttctagaccagcgtgggcaacgtaatgtgactttgtctctaaaacaaacaaacaaacaaacaaaaaacaaaaaagaaaataaaaagaaaagaaagaaagaaagaattatcagggtttagtgacatactcctgtggtcccagctactcaggaggctgcggtgggaggattgcttgaacctgggaggtcaagaccacagtgagctgagattgtgccactgcactctagcttgggcaacagaacgagaccgtctcaaaaaaaaaaaaaaaaaaaagcctcagattattaagccgtgtatagctgatccattattttaagtttacagacaaccatattttgcagtgcacatattagtatgattacacatgagtttttgggtgcatgcaaatattatattaatggatttggacatcaatcctattttggcaggcatccagatttcaaaatattctgttacatcctgactttcattcaatcaaaattgaatagtaaaattctttactgttctactctgtaagaagtcaggctaaaagtaaactttggctaattctcaccaagagttgaattagctgctgaatatgttgcatattgttttcaatgcaatgtacttcccaaggtaatcagcatgagaaagaggatatttaaaggaaagacagatgggatttatagaaatatgtcagggggtgagatttcagtcaatgtagcaggagagtgtgcttggcagtggagccaccaagaacccagggtgcatgtccctactgttatggggaggggcatggaattggattaaacataagtcaaaagactttttcacaaattttttctacacctttttctgtgtaacctttaaacacacatgtatgctccacttattaaaatcatctccatatattttcatacttgctaagtgacttgtgtgtcctaaccaagttcatgtatgactaacattagaatgggggccatatactaagacatacatcaaccaaaaaaaggttggaggtttttccatctgaagacttgtgcaaggtccaaaaagaagccagataaatgataaagggactgtaaacttcttcataaacttatatccttatggatagttagaattgttcttgctctagtgaatgctgtcctgccttgagaagttgtggagtttagtattgattattcccagcatactcttgttttaaagtttttattgacctgatccacaagttttctggcaataaccaatctctgtttatttgtccctatctaatagcacctgttctctaaggcttttaaaattagcacttaccttctttctacacggtagacattcttatcattgactacatattaactcaaggaatggttgtcgttttcagtatagtagagaaggctgggaagtaggttcggtggggagactggggcactgaaaagaaagctcttctattgtagatttatgtttgttaagctttcctaaattcttagaatctcaggcatatccatttgtaatggtaaatgtgtcatccactgccaggctaaatacagaaaactcacttttatccaaaactgataaaataaatattttgaattgttctgttctgtaattgatgtgaacagtattcttttaatgtcttccacaaaataaaaaaaatttttttctaagtttttcatgccatagtttatttaaaagttattaaaatattctataacatttttggaattgccaaatgattttcaaatttaattacattttggggagaggcaacgtgatgtaagactgagaacaaggtcaaacagatttcagattgattccttcctctgccatttactaggcaatttataatcccactaaaatcattctttcatcttgaaaagggagaggatgatgagaatgttgcaataattagagaatctatgtgaatgagtttttattgcatctggctcaagcttgaaacctagtaagtattttcattcttaatgctatcgtgcttctagatcatctcagaaggatattttcttcttttacaaaagtaaatttgcacttatgtgaatgaaaatgctgaatatgtgtgtgtacaccattatcaaatatatacacactatacacacacatatatatatatttatgatctaaatgctatggatcttttataggtagattattatagggcgttagatgaaaatgaattcgtgacaacttgactgatttctactatttttagatgaagagtctattttcacaaaagacttagagtcttgtttgatatgttcatggtttaatattctctttccagaagtttggtgcccaggaatgatttacttagaaattctttgcatacgggaacaggtgatattatttagttgaaatttaagaaaagttagttgagtgcataatcaaaaccgactttacatttgggaatgttctccagccaagctatgtattatctaactttaatattattgtaattcgtcatgcttactggttttctcaggtcaagacaaaataactatgtatcagattataaaagatagcaaatgaagaaaagggaggataaaagctatttttattattcttatccccactctctttttgatatgtaaatgaagattcagtttcttattccatctgagaaagtctgctctgaaaacagaaatgtgacaaatctgtattacgtaatcaagaacttgagtggcaggctgccctgtgatttattttcaaataatggaccagagagaccacttgaagttgcattaataatgcttgtacagggagaaataggcctttcttgttattggaacatgggtttacttttggcaagagttgagtaagtgaaaactctgatattcatacttacattaatcacatctcacctccaggaatggttttaatgtaagttaatcaatgcaaaacatggctcttttttttcacttcacatgttttaaaacaagtactagaagtctttcataaagcaatcctttaaatcaatgtgtcacaaatttgcattgataattcttctctcttagacacagaatagaagatgaggaactgagacaatgtttgaatagaggtaaaaatatatctttttgagaggaaaaaaaactgaaatccatgaaggattcctcaaatttagaataggtcatttgtctggcaaaattagtctataatttaaatttcctaggatctatgaaattatgaatagattttctatctacctcactagcttttagggacttcaagggaaaagacgatacgtttcacctgtatgtacttttttagagtactataaaacataagtggtccaataaataaagtgaacatattttgaagccaaacccaacatcttcatcagggttatttctttttttctgatcttaggaattgtgtgtaccctacttcttgacacccatagtgagagtgataggcatgtgtgaattgaaccagaagttgaaatgaaagaaactcccctccctcacatttatgaaggttgcttataattgctccaaaatgagatttgctcaactttaggccactgtggcatgatgagtggctcattattacacatttctatttgctcagcgtcagtatctctgcactctaggatggtacttctcgttccttcatctctctttgcatgaatgccatctccaaacccaaatccagttccctccgcctctctacatttctgagagccatcgtctgtctaagagttgattgactttctgagaaagaatactttgatattggctgggcacagtggctcgtgcctgtaatctcagcactttggaaggccgaggcaggtggatcacctgaggtcaggagtttgagaccaggctggccaacatggtgaaaccttgtctctactaaaaatacaaaaattagccaggtgtggtgccacatgcctataatcctagcgactcaggaggctgaggctggagaattgcttgaacccaggaggcagaggttgctgggagccaagattgtgccacttaactccagtctgggtggcagagcgagactccatcaaaaaaaaaaaaaaaagaaaagaaaagaaaagaaaagaaaaagaatagttggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaaaaaaaaaacaaaaaaaaaacaagttttaaaatgctttgtgtccataggcaaggctcatttgacatttcttgatttctcctttgtgatgtgctagttctaggtcagtggtccttagacttttggcacctggccaccagacatcacagaagtgcatatgcatcttctgtactttgccatggcaagaggttacacgcaaagccataatgccattctgaacgtaaactgtgaaattcactactccagtgaaatggcagtgccaccactacacaaacagagttgactttctcaagcttcccctcttacactcagcatgaataagcaactgctgatatctacacacagcatctgaaattgcaactcccagcaatgtagtagcaattgggtgaatccctcctaaaggagagatgctcttaacaactggggaatgcatgcaggtaaattttagagctttcttgggacattaatggaaacaacagacttctgatacactgggattcttggtaagaaaggcttctcccccgggcgtggtggtgggtgcctgtagtcccagctactccggaggctgaggcaggagaatggcttgaacccgagaggcggagcttgcagtgagcccagatcgcgccactgcactctagcctgggcgacagagtgagaatccgtctcaaaaaaaaaaaaaaagctatttccagaagctgattatttgtatttccagacagagttttcagagcaccaagttccaatacagaccagagaaatgattatatgctaaataaataagtccatgaggataatttttcagacacatgtaattatttttagtggatagacccagggatttctactcatttaacctgacgttaaaccctagaaccttgacatactagtttgagcaacttacccagcctctctgtatctgatgcttcatctgaaaatgaattgatgtttattttgcagaactgttgtgaggatcagcaatgaaataggtttactatccaagaggtgctgaaaaatggtggtgcttattatttggttattaatatgtgttgggttgttataccggacatagacagagcgatggaaaatcaaactatgttggatgttgaagttcccagaagttggaaacacagctttaaagcaccttttgtcattgtttgacattggaagcttaagggcatctttaatattgagctcctgttttggttggtatgcagattatatagagtcctcctgactccaaagcaaacatggattgggagttggttaagaagctgcatggcatccatttttatatttcttatcacgcagagaagttgacaaagtttatattttgaaaatggaaaactgaatatgcatttacttttctgaatttgttttttttcccttccccatccccatggttaaattccgtctcatgcttataatgtattctgcatttggactgcagcttcgttccttctcagagctacagttcttgagctgtaacagcgaatccaaaaaaactaatatggaatcacagatggtgcaaatatttgaaaatagataaatacaatctaggattagctgcttggactcagaaatgtcagcttcacattgcttattggtcacacaaggcaattttagttaaggaaaacacaggacaaagccatcatgatataaaattgctggtttgaagatgtgcagcataacaagcccataattgttatgtaaacctcaaaatgagtcattctgtaacaagaaaaaggtattttagagagatcacaaagcaccaacaggttatatagggctaaaaaattaagcagataccataactcgttcctgttgtacagtaccatctgctgacttccatttacagccaatttttaaggagaaaatatctgttctaatgggtatgctttaggtaggcacatattaaatgacctgagcatgagatgcaacagtcaaattgccagcgtaaaatctgcagatggtaattattagtaacatgcactgtgggctcatagttctgactctgagagtcttaaataatagaatcccattttctctccattatccccctttaagatgtacatatattctgaaggaatcttacaaccgactatgtgattaagttatctggtttactgataaggcagttgagaacgataaaggctgatttgctcaaaatcatacaactgatcagtttggtacagtagaaagaagagttcctcccacctaggttaagagttggtagaaggagcctcactcaattatcagaatcatagaaataactttggattgtctgtgatgatgtcgataaagaaaaaattgatgagaatgtaagtggaaaggttccagctggtttaggattttatttttatttttggtagcaggtttaataagaagatgtattgtatagattctatctgaaagcaataaggttaactatcatggtttgtgtaaagtctaggttttctgcagtatctcattttcctgatgaagtagaagagagtaggaagacccgttccagatcagacatgaagatctataagacagtattgatcgctttcaatgtacatgtttccaaatgagaaaatgtggttctcgtataagtatgtagtgaatatttgtcaataatttaacttattaaaggagccatcaagatggtaaagttggttcaaacagtatttgaggaagagagatttatatagtctgaaaaggaatggcttacaaagtttccaaaattaaatacaaaactggttaatattcaggccataacttttgtgtttgtctttgatagcagacagaaatttttgggtacttatatattttctataattaacatctaactttatagactgtgggcctatgtaatagcaaatagtaagagaaaatagggtacattcccctaaaattctataatcatatgtcggctgattagatagtgccccagtttgacattgaaaagatgaatgtatagttatacttgtttttatttacagttctcgaattgttttcttaacattcccaagctcagaaaaattgtgcaatctgggcctacacttgatgtcacagccaacttcttaagtcatgttattaaagttttctgtaaaccctgtggagcttccagtgtcagatttgattcaccagcagtgaggtcctggaatgcagccagtcagccaacattgcttgtcgggtttgtcccaagaaattgatgcaggtgtctatgaaggctagaggagaacaatttggtagtctcaaatagcttttctttggagaagatgagataggataattgcacacaaggaagtgagaaaccattcttgaaggatttagcaaaatgagattcggatcaagctgcgtggtggtagttgttcctggagatggctacttttagaaactgcccttagggagaagagagattaactaccaacatggtgtgatttaaggcatatcataaattttcattcccttgtgactcgcatctgtgactgtcagtgctctgaaaaatagctcttctcattcatctgtgtagctctggattccaccatgacttcctttgttcctttaacttctggctgggcaggggatattaacaatttatgtctaacttgtatcatttcctgctccgtgattgcttggtatgctctgtcttgagaacccatatttgggggccagagaagatgaaggtcttatgaatttaagaggggtgggggaacaggaagaaataaacatatgaatgggattgggaacctcaagagagaatcaccacttgcacatggggcaagctacttcccttcccttgccctttcctaccagtgttaaaaacaaaaaaataagtttacatgagtacttctgtgcagtgtaaaaaggggttcaatgaataatttggagtttaaaaaacttattgaataattgaaccttagtttcctaaaatatcttttactttctcacagaaaagaccagcgctattcaatagtacatactggaaagatgaaaatgttctgtattggtgttttccaatatgataaccaccagctacacatggctatcatgtttaaacacttgaattgtgacagtgacactgaagaattgtatttttaattgtacttaattttaattaatttaagcttaagtagctgtatgtggctagggctactatatattagagaatcagttttagaacactatccaaactttaatgtgggtatgaatcacttggggatattgctgaaaagcagattctagtccagtgaatgtgagctggggtccaagattctgcatttatagcaggtgcccagatgatgcctagtctgtggaccacactctgagaagtaaggctttatttctcaaaagcaaggattctctaatcctaatttatgtctttagccaggctgacacttgtcctagaggatgagtcagatgagcctgtagcaaaattacaaaatatgactttcaaattataaaaggaaagaatttcagtgacaaaattattagtatttttattattgacagtagctaaaattttgtgtctatactatttatatatgttgtatatttatattttatatattttataaaaaatttaaatatatttatatataaatatatatttgttatatataaacattttatatttataatatttatatatttatattatgtaatgtaatcaattgcttaaattttatttaatcctcaccataaccttatgtaatagattccacttttattccagttttgcaaatgaggatctgaggtttattaaagttaagagactcccaagactccacaggtagtaaatgcagaagttgtcttttgatcacatacagtcatacatattataataaccatcaacttctttcctgttattaagtggaggccaatgatttcccacttgcggctgatcaataaatcatatttgattcttttctacaaaggataatagtaagagccatactagtagttgtagtagtaatgctcactagaactctgtgtacaagttagaactgtcatcctcacttcaaagatgaggaaattgaggttcagagagggaacctctttggttacataatttgattacgaccacataacttgtaggtaggtggcagaactgggttttgaacctggattgtctgcctctggagtccatgcccttgtctgttccagtagacagtttctcatgtgtttggtgagcacctgctcccttaggcaatgcactgtgagcatggctactgccttctgtatattcaattgaaaatggagtttactttgaaaattttaatcatgtataattttatgtctatcaaaaatattttaagacaaaaagtcactctttattgtccaaaatgtataatttagtttgtagcatctttgaagccagtttttaaattcgtttgtcatccatgaagctgactttttaattgtgcatatttagttttagatcttacctccacttttttattagtgaagaactggtgagcactgtaagacatgtacatgtacgtgtgtgtatatgtgtatatattaatgtaaactttacaatttagaaaaacttaaaattgtcttccttgtctcccgtaatgaacttgaacgacaaattggcttcatcattttatgaaagagaaggtgaatgctttgctcccggtttttcagtaacctaagcatctgatttaagccttatttttcagaggtctttgtcattttgtttagttcggcagtcggtgctaacggagtctatttttttcacttccaattttaaataaaacacacaatcttctttaatttctgaataacatattcatgtagttcaaacatcaaatattacacaaatatatacagtggaacgtctccttcccagagttgttccccagctgtgcagctcctcattctgtcattcttttgataggtaatcactaatattattttcatttctttcttccagagaaatgtttgtagtttcaagctagtctagacacattctttacctctccttttataaaaatgttagcagacatgtttattttgaagtgtataacattgcttttgttttgttttgtttttgtttttgtttgtttgtttgtttgagacagagtcttgctctgtggcccaggctggagtacagtggcgcgatctctgctcgctgcaagctccgcctgccaggttcatgccattctcctgcctcagcctcctgagtacctgggactacaggtgcccgccaccacgcccggctaactttttgtatttttagtagagacggggattcactgtgttagccaggatgatctcgatctcctgacctcgtgatccacctgcctcggcctcccaaagtgacattgcttttttttgataaaaaccttgatattatcaaaatagaccctctaaaagttggcttctttaaaaaatgttcctccttttttcatgatgaattagatattatgtgcctcataatctgataagtgatagccagtcttggtgcaggtgtgtttactgtgcccttgcctacaaacagaagggaagagccatgctctccacacattgcctgacaaagagtaggtgctcattaaacacctgagacactgtctaccggagtagacaagggcatggactctaggggcagacaatccaggttcaaagcccggttctgccacctagaagttatgtggccctagtcaaattactttccttctctgaaccacagtttcctcatctttaaaatgagaacaacaaactaacttgcacacagtgttctaatgagcattattactaccacgactactatgaataccactactgtcatctgtggaggagagtggctactttactggtcaaccacaatcagcaaatcattggcctctatttaataaagaaaataaattgatggttattatgatatgtatgattgcatgtaacctaaagataactactgcatttattagctgttctgttttgggtatcccttaacctctctgaacctcagctcccaattagcaaaactggaataaaagtatttgatatgttggcatccacttcaatgctatatctgtgcatgtgtgtatgaatatgtatgtatatatacatttatttatatacatgctttccaacttaggatgaggttaggtcctgacataaccattgtaaatcaaaaatatcatcgggtcaaaaatgcatcataaattgaaactatcataagttcctctacctattatgggattgtggtttctactggatgtgtatggctttcacaccatggtgaagccaaaccatcataatcgagggaccatctagatagcattggtctacatatgttaatggggatcttaacaaattaaaagtagaaaagcttcctccttatccccagcattagactcaagtatgtatcccagcttttgcagattttaataagttgaaaataatgaatgagcctttcctagtagatgggtaaaagaaaagggctattattgaaatattctgaaacacaattctataccttataagatattcatgttaaggaaacaataaaataatatttagaaattttaatgtagaattgaacaaattccctctattttcttttataataagaaagattatattcctggatgtttgaatgacactgtgaagtctaaaggctagtaatggacataatcccgcattattaaaatgttgtttctgtattattattaaaaaatatagagactctcaatacatgataatgaatacgtggtgtgcttacgttttcttatataccgtgggataagcataatttgagaaatgagaggcatttctttaaacaatagactgtgctttattcacctgtcttagtctaaaaaggctatatgttgctgtcagtcacagcaaaccaccctctcagtgaataaggagataatagtatttgaggtaaggatagaagaccttagactttgcagaattcttttatgtttgcaaagaaaaattacctcgataaattataagcttatggatttttgtgtccttaactcctcatatattgaggaagctaagaattattctaaacttggcaaatttatttggtcaaaatattcctctctattccatcaagtagtaatggaatttaacaaacacaccaggaagaaaaatagcagcattgaaatgttttattgatccgtaaggatgaccagctctaccaagactcgaaaccgtttcacagaaggaatttttagttaaactattcttaacaataggaaaaacaagttatttcttttaagattctgtagagattatagagctttttaaaatcaaataacctcttttctctgaaaaattttaaagaaaaatcaattttttacaatacacctgctgaattattgcagggcatatttggtagctgctaatcttttaacacaaagaagaaacttgtagttgttaatgcttctaggaagtcaagctgctgaatggaaagtggtttttagagttcagattaggctttaatctttgatgtcctgctgggaatattaggagatgtatgggcatggttgaggagaggtacactgatagaaatcaactacgactttgataatttttttcaagaatcttattaagtaacccagacagaaaaggtacatgaaatgttaccaggcagattcctgatttcatattataaatactgaataggtatgacttgaaataaattttaatcagtcactacttacatattcgtacctaaaatttgggtaatggtaccatttgattctatcataaggaatcaagcctcttgtgtgttataatccaggatctttaggtcaaacctcttccttttgtgaattaacctgaaaatcctgtcagatcttctaattacggtgatatagggaagtttaataggaagtcaggattcccttgacctctgagatttcagtgtttggcggagtaccaagctctctgtttcaccagctactgcagagtcttatgacatacccaatggttgaattataagttatgcccctgaatacatctaaccatgacatcctctcactagaaatgtacatatgtatgtagatacccagactgatgctccaaggaaatgtttctagattgaaagggtgggagtgggcatgaaaaaatgtcctttctgcttatttatctcaatgtccatggaggtaactatttataatggaaggactgagggtaaccccaagaactcttgattataatgatgctctctccctccctccatgcctcccttcctcctgcctccctccctttcttaagcaaaaaagcaacaggaaataaagaagtgaataaaagttgtctcttttcctaaaaatatacgtcacttagtgaacacatctcacccctattttgatttacgaataaggacaacttaaaaactatcttctaatatgaaacaccttaacactaagaccttgcaaggtgcatctgttctttttatcctggagattaaaaaataatttacagacaaacagtttgggtgtgaaaatacttaaaatgaacaactttcattatcttttaagaaatcatgacggaagttctggtgaatgtctgtgctaacctgaagatattgagaaagtattttaggcagattctgttttatctgttacttcatatcatatcactcccttattcggtggcttaaaacaacgattttatttctcatgattctgttggtcaggagttcaggtggcttggtgggcagtgcttctggttcaagtgtgttgtttatcttgactgcattcatccggtagctggaaggtcaggaagacttcactcatatgtcttgtatattgttgctttttcatatgacctctctttctttctccacatgggtagtttgaacttcttcatagcatgggtcctagcatctcttaccaggaagttgccttctaaaagggattattccaagtaccgagggaaaaaaacccctgcagatctcttaagaatcaaccttaggagttatggagcctcttttctgccatatttccttggtcaaagcaggacacaggagcagcccaaatacaaaaggaggaaaaatgaatttcttgtttccataagagaaatggtaaggactgtgcagtcatctcggatccaccacagactatcattggctaaaacaacagaactgtatctggatacagacattcactataatagaagcatgtggatgatttaagaacgtttgaatgttaaaaatattataaggataaaagcgatgtcatgatgtcagtgctgtattcagccataatttttcaacacataccgttagccataatctatcaacacatgcagacaagttataatttatagaaaacagtctttcatgtgcagtgatgcttaaaaagataagaatttacattttcactgtaaaatagaaataaatataaagcaatcacctttatatagatgtagttataaaatatatttatttgagaataaatctaatgtaccgcttggttgaaaaagatggtatattccaaataatcttttcgcttcagggaaattatgaccatctagagtaattttgtgtcaaaaattaaaatatacagctagacttctcagaagatgtgtattttaaggaagggacaagtacacagaagttggttattatggccacaaagatactttagttgtgagatataattacattaatgaattctgccactgtgaaatccttgatgttgtcacatttcaggctggaagaagtaattgatctgggattggtgggattccaaagatttcacagaagaaagctttttcagatggttgggggaataatcagggaaaacagtctttggggttatcaggaatataatataattctctatgaaatatctttttaaaattattccagcccctctttgggcattaacagtgcatgaaagtatcctgttctcagtgatctaacctttttaaaggtactccaatgcaaaggactttaacgcaaagtgtagatactcctttctatggaatataaccctagtcatgacaagtttctcctttgtttactccttggaataagtgaaggtgatttaactcagagaggaaggtagggaagctatttcagaaggaagatacctccctaacctgagtgatgggggttacctttcctttgcttcccactcctccacattgcctgttttgcttaaaatatgacttcatccctttttcttcttttgttgtcatgggatattggaatgtaggaaccaggatgtcctgagtggtaaacttagctccactacctgagaaggacgatgtggcatacacccaccccatggacaacaggctgctgggactcctttttggaaacatgaaatatttacacgcacacacacacacacacacgtacgtgcatgcgcacacatgcacacagaggcacgcacattaactaagggaaaatttttactttaacacttcccttggaataataagccttgtagaactaattgtggccagattttattcaaagcagaaaataacatagaggaaaattacctactgctgtaatgtgatggttttgtactccaaaatgaacatgagaatgttcattcattttttagagataggttttttattcacggtataaattttgtggaaaaaaaaaatgtcattcttccaaactggttgtgacctgtggaatttgggaataaagccacgtgtgcattttaagcattcctaccttggtgctttgggttaaatgccccccagcggtcatccaatagaacctttttcttgcctccctcaggctttgaaattacctgtttactggtgtctctccatatacctacacatttcttgagggcagggactggactttcttcattttgaatcatcagtgaagagtttcaaaaaatatgtgtgaatttgcatttgtagtagaagtgctttgaagaaaagagagtttgaaatttaggagagggttccatggcaatctttattaagttgattggtatttataatatcttccagtctgtggatcgttttaaaggtatgctaggctagcaaagctgataaagtcagagtgatctcagattgacaggtgggataaataattagacttttggtatataactctcacagagaaaatctagagtgagttgatgcacagtagaaggaaaagagctctaaaagctagatcgaaagagctttttaaaaattaggaagagcaagcaaggaggaggggaatccagaggacaggaggatgtcagagggctgtgtttcatgggggcctctaaaagtgtccatggaaagaacgctagttgcagagctcctgggggagacaggaggagaggtgcacaagccaaactaacaggccagagtgttttgtttgcaacattagttttaactttaaatacagccagtttctttggactcgcagcccagacagggagagggaatagggaactcaacgacttcttgaataaacaattgcaagaaagtcagtaaaacccaatgagaccaataatgaccccacaaggtagggcctgatcctgtgggagattatgggtcagaataaaaacagttagtattttaaacgtgtgttcagtcatctgaatgatataaactttagctattattattatttcttcactataatttgtcaagtggaattcttttgctgcctgatgaagatgatttgtgcacttgagctgaccctgtattggatagggaggaagaagaggtcatttcaaatagaaggggaaagtaaagaaaagttgcgtgaatatctgtagaagacacgtgtgaaatcttatttcttctctttattggacttttacaagacgatggcagcagcagccagggatgcaacaagagtcacattcgctttgaaggctgcccttgaggaatggccccatttttcacaactgtacagaagtcatctctaggagagctgcagcaggcaaagccaagccggctctaattaatgacccaggctaatattggtctttgacgttcttggatattaataaatgttagataagaaaagcagctgtttatctctttgcccaatacaccttcaaacattcgtacaggagatagatatcctaatgtaaacatttgcagcctcacatattgtcgggatctctgaactgtgactgttgacagcaggttgccttaagtaattgcaatgagacagaataatctagtagaagctattgtcatcctaagtaatattttcctgagaaacagttatgaaaaatgaataatagcatttagtaatgcataatgtgagagtcaagaagaatattgaagacaaaggatacaatcatcattgcttgaggaaaactaaattttatatagctgtcctttgttgttatgttaatcaaattataaaataagcgatagtaggagaatagcattgctgtgttataaaattagttttagaattagattagttctgtgacatgagatggatcacagtgagattatacctcatgagtactcaactcttgtaaacactacaatgacatcgttaaatattccatgcttaaaacgcacagcacgttaactcctttatttcaggggttcgcttttatagttagagaaggttttttgtttctttttttttttttaacttttagactatacgcatacaatatattacaggtgcctgtgactcgctctaaaaatgttggaagctgaactgcatcatattcttgagggagaacttaatgtcaagaatttaaatttgcaacacccattaatgtgtatttagagcatttcaacaaagaaatacatttagtgacaaaagttttaaagtattacagaagagtcagaactgaaagataactcatggaattttaatgtaccattttaccaaatgtcctaaaaaatgatgagtactttcacaagtaaaaaagtacctaaaatttattattgttaagaaacattttatgtcaatctatgttaaaaccacaagtttgtaaatttctgaggaaaattgcattaagagtgtatggatattttaggataatgattaaaataatccaagagaaaataacataaatacagatatttaatgatatccaattcggcatagatggatgtggctctaattcagtgtggcaggaactccagaaagctaattttaacaaaagaatgtaatctgaacaatattaaacatgtaggtcactgtatttagagataatcactataattttaaacctattagtaaaggttgtaatgcaagtgtgttgtgctagagttctccaggaattactctcacttctctactgaaaaatattaaaactaccttcaaagataaagctgattacagcataacaaagcaactcactaccacctctacttcataataaatacaccccacattgttgtgttagacatgagtttcacacaatttattgattagttgaacttttaaaaagtctattatgttgacttcatgtctaacccttttataagtgagtggaaataagttcttttatttcttcccctattccctcactctcatcactgcggagctccgttgtttttattatcttattcattcctggtcttagttctcttagctttgttctgttttacgtgtaaacccatttctatgtggaagttcttctatgcagagagagcaggagtatattctttatgcttgggacaataaacatttatagactgaacattatacaccaggaattgtgctaattgctagatttacattgctggaggagacatgatagtcctctcagagcctacggtggaatacaaacagagcagcacagtgattttctgagtgtaacagagcatgcagtcaatgctctgggtgtcttaagagctttgcttagcttatccttggtggtagtagtggaggtgagtcaaagaagtcttcctggaggaggtgacctgtgacctaaaatgtgaacagcagataggacgaagaagggggaaggatggaaggtggtcatttcaagaagtaggaagcagcatgctcaaattgtataaccctcaactgtatagtatttgtggaaaaattataagcaatttatgtgactatcatatacagttctaggaggtggtgtgtgatgaggtaggaggagccatgtcatggaaattgttgtccttgtaggatattcacagcagcttgggctttaccctagaagatggggagacagttggagagttttaagtaggtaactggcatggctgactttacatgcatcattctgccagcaggacacagaaaggacttagaatagttatatgctagggtacagcctctagccagaggatgtcgacaaaggacctggactcaaatcatggtccacaattctgccaggttctagccctactgaattcagaaggtggtgcaaagattcttttttttttttttttttttttttttttttttttttgagacggagtttcgctctgtcgggcctgcggactgcaatggcgcaatctcggctcactgcaagctccgcttcccgggttcacgccattctcctgcctcagcctcctgagtagctgcgactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtgcaaagattcttacaattcataaagagaaacaaatccagctatggagaagaacttactttttagtatagaaactttcagatatttatggacatttttcatacatactaaatcttgaagcagagagcgacaaagacatacatttgtgattcaccagcatatacatggtcgtgaaaattgtgaaagtggatggagttttttaggcttggtttatattaatataatgggaaagtgatggtccaggacacctaggaagtttgggagttcaataacaagggaagaacttccagagagagctggaaatggaatctgtaaattttaaagcagctgggaagcagggatgaaatataatgtagtgggtgggagcatgacaaagctcagtaggcctggtgtggtggctctcgcctgtcatcccaccactttgggaggctgaggcggtcagatcgcttgagccaggagttggaaatcagcctgagcaacatggtgaaaccccatctctacacaaaataagaaaaaacaaacaaacaaaaaaattagcagggtgtgatggtacatgcctgtagtcccagctacttgggaggctgaggtgggagtatctcctgagccctgagaggtcaaggctgcagtgagctgagatagtgccactgcactgaagcctgggcaacagagtgagactatttcaaaaaaacagagagacagagagagagagggagagagagaggcaaagagagagagagagagagagagagcgcactcaggagagaagagaaatctcaggagagaagtaagtttcaagaattttgctgatcaaggaaggaggaagactaggaatggaggaaacatgaaattcagcagactaccttttgaaaatttttgttttatattatttgtatgcttttccttcgtattttttaggataaaaataattgaaagatgtgtatgggctacaggcaaagagctagttgagactaagattggaaatatgggagaaaacgggataattaaagaatcagggtcctgggtgaatgtcaggtaactggatctttctgtataaagaagtttgggctaatatctagaactacattatggtaaattttcacggaaattaactcagagggatcatttccagagtaattttaagcctatagagatattttaagaaatcaggccatattttagggtctctcaagaaaattcacagaccaggtcataaaatacaataaacgaaatgttttctaaccacacataaagatccttatacttgcttataaaaagagatataggaatttatactacactgcaataccatttatcaccttgagattggcaaaatccaaaagtagtgaatactgtcatgggaattgctgttggaaatgcaaaatgctacacctctttatggagaggaatttgacagtgtctagtaaaattatatatacttttaccccttgacccagcaatcacacttttagacacctatttcacaaacctattggtaaaaatatgaaaaaaaaaagcacacctaaggctgttcactgtacgtctatttgtaatagtgaaagactggaaacagttcaaattttctttaatagtattgttgcacatctatacaaatgcaatacttcacagctataaaaatgattcagaaaggtaactatactaaattttcatcattatatatgtatacacacatatgtacaaatatacaggtgctccttgatttatgatggaattgttataaatagcactcgaacataaatttaattttctcagcaaggcagttttacttctatagaagggtgtgacttgcagatggaacaatggcaagagcacccctgaacaagggaggggaaggcgttcttattctactgctgtgtcattcccctgttgtctagggttggaccacacagtctaagctaatgccgattggctatttttaaagagatcaggggtataagccggagtggcggggtgagtagtttggcaggaaggatggttacagaacaggtgactcaggatgagccgggacagagcaggcgacaaggggtgactcaggtcaaagcaggtgaccaggggaacagatgtgaactactgattggaactgacgggaaagttatttactgaaactagagccaaggggtgaagagaaccaggaagttaaactttaaaatggagcatcaaagaataacagagctgaacatactgacatactgattctttgaagagaaacttggggttcactatatttaacaatcccccatcttgaattttttcagttctttctcttcagacttccttaacatgacttggcttagttgttctgcttgattctctaaaagaaaaaacttctctgaataaggtggaggagaatttagaattaataatgtggaggacgttttagtaagtgctgcctctatgagtctgcgccccagcccacagatgcatgctatgacacaacacccgagaagaacgagtacaccttctacgctgcgagagaagtaagcatcgaggctatgattcctttccatttactgtaccatttttctagccaccctgtgaaggaggcatttactcctcctgagtttttggctaactccttggacagagcagttagaccttgcaatgcctttgttatacttccatcaggggtggtattgtttggatgaaggtgcaacattgagttttcatcatgaggtaaactcctccgctttctgctaatatcatgtctaaggctcttctattttcccaagccctctggctggtagcccctaattgctcagctattcctctaacagcatctctactgtagttaataaaccactgttggtagtaataaatgtaatttattcaaactatgttcttattaattgtcacccaccaaaatattgacttaaatcctgcagctatttgatcttgggttttaaattcatctggtactcctcgtggaactccaatagcatctatgtaaacatgggggtcaaaggacccatgtgaggcacttcttctacaatttttttttaatcatgttgacggaatcctagggtgaaaggcatgaccagttgaactagagcacaagtgctgctctaattactcggcagagtacccagcaagagtcccccgcaataccaccacacatctgctaggggatgaacaagggcagactggtgggtaagctcttggaagggcttggtttcactgcaccctgttaagtctacaaggaatactcgcttttcccccggcggtgaaaggcacctgttgaagttaacatcaggggctggaggccagatggccctcgggggctgacccacagggttcaacctcagggaacagcagtgaaagagtctcgcatgactcatcgccccaggctgtggggttttggaagagagctaccatacagctcatgcccggtccgtgagagaaccgcccaagtggaaaggggataatctgggtctctggcctgcctgtcgcacataacagtcgcttttgtttagcgtgcgaacagaatatttaatccattccagccaagcatttgtgtcctgatatcctgtttcaattgctatagtttgtttcaaatttttaacctctacagaaactactttggttttatcattgggtttataacaagagaaggtttggttagcggagaactcaggagaggaagaaggaggtgcaggaggtgaggaggcaatgaagcacatttcaaaggatcctatggggtccttccctgagacttctgctcctatactatagaaatggcttaacgaaggggaagaactctggggagcagagatggtaatctgtactgggttacagtgatttatctgaccacggggagggctaactcctttagtaaaatgaatatatgtggttttaagaaactgcaagtactagctggggcggtccatccttgctcttcggtgttttacagagcattggaccaacttcggcagagaagctctgctctaggaggacaagatttccagtttacactggaattttcgtcaaacacttctcaaactaacttgtcccagttcacagatttttagtctgaggaaagctaggaaggataaagtacttttctgaggtggagagttgcctctcacctggcaaatctccacagggtataacgaggcaaggatcaaatgtaatagtttgaggcagaattgacgtggttacgttaataagtaggtgaccagcaatagagtgaggaaagaagaaggagtaatagaatagatgaaagagagttacatttttcttagctttagtttggtagggttttcccctaggactatggcccatgacttgggagggggcggcgctttcttgacttgagtattatgggtccatcctttttctggtgtccggactgtggtttcggtagttaggagcactaggtaagatccttcccaggccggttcgagcttttccttctctccagctttggatgaggacgtggtccccaggctggtgttgatgtactggaaactccaggggtggcacctgtgctaaaagacctttagctctgagggaagagaaagtggaagataaaccaagtatataacttctgagaaactgatcttttgtttcaaatgtcgggagatcagtagtagaatgtagataaggcagtccataaagcatctcataataggataggcctatgtctttttggggaacagttcagactctcaacagggtaataggcctttctactttccctgatgaaggtgggtgccagggattatgatattcccatattatatccagtacctgggctaatttcttaatggcacgtgcagtgaaatgagtcctgttatctgaagcaatgttttctattaatctaaacttgggtataatattttcaagcaatgtcttgactgcattattagcagttgtacttggaaagaaaatgtcttctacccaatgagtaaggtggtctactattactaataaatactttagacgaccaattggaggcatctctgtgtaatcaatctaggtactttggaatggccttaagcctggactccttcccccaaggggtaatcttttactaagcaattgtctgtaaccatttggccagggtataaatctctatgcacccataaactctgaggactgcatcacacatggcttggggcccccagtgggtcccttgatgcagttggaacaagatttacctcataaggggtttggataacatttctctcagtctagcaatatccagtttccttctgaattctctttagtacctatttttattagtttttagaccaaagaaaaccaaacagcattttatatttgacagtgcttcctgtatgatttttataccagataagctaaatttcacctttatattagtgggctattaatgttaaactcaattttaataaaaccttgtagacatatttatccaattttaatgtctgaccataacataagatttttatagactctttttaaccctttataatttttgttaaagagcaggttagtgctttaagaaaaacccattgtgctttgattttaataaaaaattaaaataaattttaatttattttaattaattaaataaattaaatccttttacacggaatttcctttacaattaacgtttcaaaacttgcttaaactttaaaacaaaaaaaaaatttttaaccttttaatgtaggtatgaatccacattcttatgcctccttacaatccttttaccaaaagtatattttactttccttacacaccttgcaaataaactgtttcttcaatagttttacattcaggaggccgaattacttttaaattatacaacatttcttgcataaattcccttttataacatgtttcacaactttcacagacaatctttgacatgccttaactttttgacttgttgtaaacatccctttttttaaacaaccagttaatttactttcggacaagaatttaccatgtaagattctttttacatgaactctcctttttttaatgtcaaagatgataacagttcttttccaaagcaagcttcctttatgtctgtggactagactgcctaagaccaccagattagaagttaggataatacatgttacagtgttaacttttagcaaactttacttttgttgaaaacctgtaagtttgggattttaattaaagaaaggcttttctgatgtccagggccatggacaatagctgttccttttggcaagtgaagattatttatacgtgggtgattaattccttgtggaacaggtcttggtctttgctattaataagccctcattcagtccaaatttttccaaatgtatggaccactcaaaaggcgtacttagaatcggtaagatggttccttcctggttctctaagtactttaaatcttggctgagtgcaaacagctcacatgtttgagcagaccaattattaggcaattttcctaactctatttctacaagagtttctctatcaattattgaatacttattgtgtctttttccctcaatcacccgggaggaaccatctataaataagtgtcatccagtcctgaagggagtttctcctaggtctggtcgggcctttgtatggtaattaattaaatctaaaaatgtgtgctctctcttacgatttggatcccctgttaggaaacctgctgggttaagtgaattatcagtggttaatgttaaatcatctttttctaacaaaatagcctcacactttaagatttttgggtcagtaagctactttttggctttctgacttaggatagttctgaccttgtgaggtgtgctcacaatgaagtttcctccaaaagttatttttctactttcttctgttagcaaagccgttgctgctaccgattgaatgcatttgggccatctgcgggttactgggttaaggagtttgttgtttttttttttgagacggagcttcgctcttgttgcccgagctagagtgcaatggcgtgatctcggctcaccgcagcctccgcctcccaggttcaagcaattctcctgcctcagcctcctgagtagctgggataacaggcatgcgccaccacgcctggctaattttgcatttccagcagagacgggatttctccgtgttaaggatttttgataggaaggctacgggttgccagtggccttcgtgcttttgggtaagtatttctaaggctacgcacttgtttacactgacaaaaagatggaatggctgcttgaggggaaagctaggacaggggcagttactaatagatgtttcaacctttccatctgttggatttctggtaatggccaaacgaaggggtttggcccgtcttgcgtgagctttttgtataaaggctttgtttttagggcataagagtctatccatagacaactgtacctgactaattctaaaattttttaagttcacagtgttctgtgaacatttgtggaatctacacggcagaggactagaatggacatttatgagtgatgtttaacataacaatgccacctgttggatacagtaggagattactctgtgtttcatattcttagacactgatctcagcagacacagaatctcgggtcccctttggaaaacagcattttatgaagagcctttgatgcattatgcacaggagagaaatcgtggcggtgaatttcctagtgttgggttttgcctgtcagataaacttaagctgggacagtgtcttttgcagatttggggatatattttggacattcagtgtgcgctcatgatgatcactgactggacaaacttatgctgatgagtcagtattgttattagaagatgagaggggctctgtaatttgaaatctattttctactcctgagacattgaaagggattccaatttggattcaatgtgggtggctttcaagatagttcttttaagatcatgtgatctttgcccttctcacagtttagtgttgtctatttttaaagggtgttaggagtaaatgttgtttatgtttaagcatgataatataaccatacctcaccgccacccctaaaacccgtagagacgaatacatgatagggattgcaactgtggaaggtaaacaaataagcaattttgctcatttgttttttaaaagtgtgactatttgtcttgatagtaataccttgagcttgtgcttcaaaaatctgtccagctattctcttctgcagacatattcacactctcaagcctgcttctgttaatgtgtttatgtgattgttctaacacggtgaatactgcttttgactatatgtacccagaaattattattacatttttttgtaatttacagaaattattattactttttttgtaatttagataacgaaccaaacttgtggaccttttttgttcatttagaagtggtaaaggttgttccgtgccttgacagaattcttaacagctgcctctgccttggttttgctttatgcgcttccttccctcaatggccatggcattgtatttcgggacactcttccctccacaaagcaacagggcaattcttcagtggatattagaatttttctcttctttttctgcaaaccctgatgcacccatacacagcatatcttttgttttattacttccagtttggtgaaaaactggatttgtcatgacaaccaagtatttagtggaacagaagcagagataaagaacacatcttgaaaggaatacacaggatcaatatttcatgtccatctgaagtgttttcagtgttgttgaggaaaaagtatacatctcattgaagtgtcctttttttcccagggaccagatgttcattttatttatcaattgtggacaatccgtcaagcccagcaatatttttccagagatttccccctgtggttttctaatttatttgatatttaggaaaagaagaattgcagctgctgcagaagaattagagttcaacttacgtgtatgtgatcattggagcatgttcctccgtcagacattaaacgtttaacaggacacagtaacttatgcttcgtttgaattttgcatctgcctgcttctcctaactgggtgaagaatgctgacaatgacctactggattagttattcctctcctctattttatgaaatatttcatattttatatttcaaaatatgaaagcatattttaaaattactataagactatatttattttagatactctccacataattagtattgcagagcttcctgcttcaaaatgtatttgtaatttttttctaattgcactgacccataatagctaagattgaacctacatttaaaaaatttaatttcccttcatgttagtgggtaactataaccataaaagagactctttttttaaaagattggacttttacatttattaccactgtaagtgcaatgagataaggcctctgaccatgttcttttggagattgttaaggcattcatgaatcctttggagctgtcagcctgcacttctcactttgtcagaacatatggatgtgtgggtgtggtatgcaagctaactgtcctgaagaagcttgtcaaagaaatgtttggaggaaaaaacaccataacactgagcataagtttgaatatagccatatactagaataaaatatggatatcaggaaagagcttcctatcagagattgctaacattggaacttaaattgcatcttgaaaatggattaataaggtttagcccagtagtggtaagttggtggacattactagtgggtaaacattacatgggcaaaagttagtaatggaatattgaggaaaggagtctgggctgaggaaacgaaggagtaggcaaggccgggaggggtggctcacgcctataatcccagcactttgggaggccgaggagggcggatcatgaggtcaggagatcgagaccagcctggccaatatggtgaaaccccatctctactaaaaatacaaaaattagccgggcgtggtggtgcacacctgtagtcccagctactcaggaggctgaggcaggagaatcgcctgaacctgggaggcggaggttgcagtgagccgagatcatgccactgcactccagcctgggtgacagaatgagactccatctcaaaaaaaaaaaaaaatagaagtaggcaaagaggagaatggaataactggagttgggaatatggactcataaacttacctttaggaggagttactaggagagtttcacatcagcagtggtctaatcaaaaaagccaattaactccagccatttttagtcactgtaatttggctccaaattcaagttttagggtaagatatcttattggctgtatcttcaagttctttaagcattgacatcagattttctgtaacgcctttagagcctgctataaaccctaatagatgactttatctgggtagctagaatttgagatacctgtgaatcttggctgtaaaatttgactcaatttgcatcccatttggatgaagcaacaggatattagggttttgaagtatgcttatgaaaataaatatgctatgacgtttgtaattggtatgattcagaatttaattagataaactacctagcatttctctgtattttcagaatcttattaccaacttttgtagtactccccaaagagcaatttcagtaatttgtagtgtatctctggacgtgataaatgctattatatcactgtgatttgtaatagcagtgcttttcactgtgaaagatttactgagattttctaattgacttagagcattgcctctcaaactctttctctatttcttattcactgtactttctcatcacaacttagtaatcatattaatcttgctttcttggaaatgattcatatatttgcatgaagactaattaaaatacatatgcctgtcctaaatgattaggctaagacttaaatgagcaactctcagcttaaaatcctccagtgattccccagctcgctcagagtagaagccaagcctcttataataggtcgtaacaccctggtacttttctggattcatctcaaacaccctcttactaataccactcagctttatggcaccacttttggttgtggtgaaggcaccaacaaaaatgtttattgtctgaatttggcatgtgtgtgtgtagtagtgtatgtactcacatatctgaaaaatatttaccctttaatataactttctgtcactctgtatatacacctccagattcctccagttcagacatgcatttgcctttgctgtttcactggtctggaattatcttctctcagatttcttcatgtgttactccttcagcttcttaaacacgttgatcaaattacttccagtgattctttccctagagggatttacttaaaattgcatcactttttacttatttattctcttcattgtttgtgtcttctctctgctcatccccccagccccacccagacttaagatcagtgaagaagattttttttcttgttcctttacattactaaatctccagtgcctatgtcaaactccagcatggggttaataaatgtatgtagaatgaaggaaagcctcttccaaatgagtgcttaccatcattattgcctctcaagaagtagatcttaatatgaaaaaggatgggaaagttctccttaccttttcttctaattctttgccatgcttgaaacattaaatggaaccaaatttctagatttatttctatttacatctccaaacatttgcaatccttataaaaaacatggtagaggctaatcatgataatgtagataataatagtagtagtaataataatagctaacatttattgaagacctattaaagttcagatataacttttattatatcattaacaaatgttattaatttaataaaacctgtaattaaatttttaacaaacttcaaattcttgatgagcaactgagttgataatcctatttgcccattttgaatatgataaaaaacagccacacttacagtaactttatttatttgtgtgcatattatgtatgcattttttctgcttgggatctgttgtgtatttgtatggggattttagtatatgtagtgtagagactatcactgtcaggtaaattctgttatttcttttggagcctattggcttttaagcactcggcatgaaatatatatttcaaataactattaagttgttatcatctgacttttttaaaactttctacattaagggacttttcattaccttatttgaactactagttcttggtttgaatgtaacaaattcctgggaggcccgttttgaccgcaaagaacaatgtagcactatcttttttaaaataacatacctacttaccaaaagaattgggagaagaaatcttgattcatttaggattagactaaaaagttacattactttttcttttattcattatctttttgtttatagcatgtatcaagactgaagagatgatgattttaaaaagataggcattgtattatgatttgctttttcttcactgtttttataggatgattaaaaatatctggatttcataaggcataattgacaggttgcagatctgagttggagcacatatcaaataatatataaaaccttctgcttgatacttttgagatcaaacattgtcataacacccacagtgttttaaaataggccagaggacagcctcctggatagctgacctttaaccaacaggaagtatataaaatatctgcagagtagaatgactatattccaaacttagattagacagaaatgacaccagctctgggttccatcactgtttctgtgcatccgttgttgcatctgagaagcagagtgctttttgttcccccacacttcatctagtttgaagcaagaaaatttaacagtgcaacaaaacgaactgccttttccagctgaactctatcttctctgacagatggttcggttgggcgtcttttccatccagagcagtgctgtgtttgaagaatgaaagcattgagagagatcatttgttgtatagagcagagtttcaaataaccattactactggcaatctctgctgtaattcctggattttgagataggtgtacaaggaactctgtggtgagattaaacattcagctaatttttttttcccccaaagtcattaagtagctagcatttaattttttatatgtgcagattaaaaatgaaggttaagtaccaacaaaggaagctccgttcaggaaaactctggtatactctttggtgtctttggtggaaatgactattcattatgcggaagaataagactttataagaatagtatttccctaagcaggcacagcacttgagaaggttacagaatacctgtttactctgctaacctaattctctgtcgatttctcttgtcaatgccttttgatattttgacacagaatgttctacctaggaccactctgctgaatataggtcaggctctggactctttctgaacctattctcataaatcgcaattttattactgtttatacttgtctacttgagtcattccacacaatgggaacttatttttaatactaatttaaaccgaggtgctactgagtatcttgcttaacatatttgcagttcctgaagacttcagagttttatcccaaagaaataatgctcatagagaggaagcagatatactagttattccttggaagaggaagaaaacaggaaatggatatttggaaacaagagagacttccatgttcctcaattcatagcaattatccagtcctactttggatcatcctcctaatcctattaagaaaataaatgagactccaggcattacaaaatctgaaaggtttttagaaaaacaagctactctgaaagcgtatctttggtcaacacagccaaacacaactcacagttttaaaaacacagaaccggccgggtgcagtggctcatgcctgtaatcctagcactttgggaggctgaagcgggctgatcacctgaggtcaggagttcgagaccagcctggacaacatggtgaaaccccatctgtactaaaaatacaaaaattagccgaatgtggtggtgcatgcctgtaatcccagctacctgagaggctgaagcaggagaattgctggaacccgggtggcagaggctgcagtgagttgagatcataccactgccctcaagcctgggctacagagtgagactctgtctcaaaataaaataaagtaaaataaataaaaacatagaaccatttggtgattcctttagagacaggtcggatttttcacatcacttcgcagtcgatgaagccttaaactaggacctactaattgtgtctagacataaacagaagaggaaatgagtccaacaagaggaaacaagaatgattctttgtcaagtacactatttcttttcaagagctcatgttatcctcaagttatatggaaatcctttcttgaaaaatgactccacctcctgctctgtatgtgctcccagcccctccttccacagtggagcagtaagagagtgaaggctttatgtgtcctcaagagcaatgattttgcaaattcagaattgctacttcctcaggaaaacttgaagttaaaaaaaaaaatccttatttgaagaaggaaaacattagggcattatcgggtgagaacgtctctcatttcctctcacacattagggtctttctttgaaaagtagtgtttttatgtcttaggatgagggtactgcatgattcagggttctcaattttgtgttaaattaatatctgtgcattcttaagatgctatttatcaaggtggttttacatttgatcagaactcagccacagatgcattttcattatttatttttatagagatgtagtcttgctgtgttttccatggtggtcttgaaatcctggcctcaagggatcctcctgcctcagcctcctaaagtgctagaattacagacatgagcacccatgcctagcctacattatataattaattaaaactttaaagcaataaaggctactgaattttaagttaagcaattttctatgacctagaaacataaagtaaaatcactctagtttgtcacaaaatgaaaaatatatgctaattaagaatcagaaaatcatggctttatggaattgaacatattttcaatttgctgattaaactccctgggaattttaaagtcatctaattcagcttcttattgagaattttctcttttaattggacagctttggtctaaatacttccagtggacctacttgcctctacttttcgaggaaagtctatatcagagacacttgtattattttaatgtgtttcataattttgagaatacaaaattggattctgcatagctttacttgcttttcatatttctctatgtaatggggatatttttgaattctagagcagcactgtccaatagcactttctgtgatgagtaaatgttttatttctgtttaatatggacatgtggctaatgagcactggaagtatggctagtgtgactgaattactgaattttggatttcatcaatttttaactaaattaagttgaagtagccacacaagtcttccatatcggcatagttttagaaatattgttttcatcaaggacagagaaagaagaaaatacctttctcttgtttgactgcctaatgggcaaaattccttttacaaacgttgagaaacaaacaaacaaacaaaaaacaacaacaacaaaaaatcttttggagttaatgcttattttgcatagaaataaaggcataaaggaaatttcaatatatggccaactcaagtttagaaaacagtcagctctctatggtaactaaccaaggaagagatgaataaggaaggtgtagaaggtggggaataagacctgcttaccagcttaaggacaactgaaaaatgacaagaattcaactgccgtgtccaagacaatgttttctgcaagaatgagtggattttaagtacaaggaagagtgttggcttgagtctggtcttactatgtttttccctctccaaccttattttttcccaggttgttgacagtgtgtaatttcaatagatgctcggcacttttctcacatctccactggagatgagctttatacaagtgaaagtgctactgagatgggaagatgttagataatggcatacgtgcttcttttttaattttttctatgatttgcctccattccttaggtcagcatgaacagattggagagggagatgctgagtgtgtcatactgaactgagctaaattgatcagaactaagggtgatatgctcccaaactactaccctatcctatttacagcttcatctaactagtgaagtaatttttctacctcaggaaaattaaaaagatccacacatacacccccacacccagacatacacatagacacatgcacacaaatccatgaagttggcactttggctttgacctctcatgatcttcttgacctctctatgatctgcctcagcctcattttccctgtccaaacacaaaatattttatactatccaatatattttattatggattttttcttgttaaatttccttttctcctatctattcaatcaaaattctttccctccatggagaggtttccctaacaatagacttctacctaattttcatattaaagtaacttatacttagttgtgaggaagttctctaggttaagaataaatatcatagagaaactttattgtcaaatgaatacctaaatgacaaatttctgtggcgatgggcgagtttaagcagaagagactccccctcacgttctatgaattttcttcagttatcctgatttgacttgattttaggctacttgtgaagaaatagaaattttactaattagtgaaatgtcttctacagttaaaaatccattaaaccttttctgtctatttctgatgtgcagttctgcaaaaactgggccctcttaaaaggctaagtgaccgcttttagtttaggtgagatataaaaacacaagtagcaaagaaagtaatttacctttgtctagagaatttattctctaaatatgcacaaagaataggccatatgtcagactttgtccttagaattcacgggaagaaggaaaaagactaagcctctagcctcttgctattgacaagagcaatagatactacatggattatatagaccttgcatgcagttgtgatgaattcgttgatagtaacagaaaaaaaaatagccttttgacaatgccagcactttacaaaacattttagtcacaactctaatagcaaaacaaccactaaagcagatgttaccaccctcattttagaaatgggaatctgaggctcagggaaatggcctctgtggatgaaaactttaggttttgttcctggcagtagtaacaaaaaaccaaactcactaaacaggtcataaaagtaaggaagcaactcagtttcatctgtctgcctgttctgtcagatagtgacagctcctcccgtggggagcagtgaatacatgagtgagaagactttttaataacagccattctgactggtgtgaaatgacattcattttggtattgatttgcatttcgctgattagtgatgttaagtattttttcatgtttctttggccacttttatgtattctgttgagaaatgtctgttcatgtcctttgcccattttttaatggggttgccttttgctttttgatttgtttaagtatcttatacattccagatattagatctttgttggctgcatggctagtgagtattttctcctattctgtaacttgtctgtttactttgtatatagtttcttttgctgtgcagaggctgtttagtttaattaggtcctacttgtcaatttttatttttgttgcagttgaatttggggacttagtcatagattctttgccaaggccaatgtccagaagggtatttcctagattttcttctataatttttgtagttttaggtcttacatttaagtctttaattcatcttgggttaacttttgtatatggtaataggtaagaatttaattttattcttctgcatatggttagccagttatctcaggatcatttattgagaagggaattttttctttattacttatttctgtagactttgtcaaagatcagatggttttaggtgtgcggtgcggcttcagttggtgggaatgtaaattagttcagccacagtggaaagcagtttggaggttcctcagagaactaaaaatagaactacaatttgacccagcaatgccattactttgtatatacccaaaggaaaataatttgctctaccaaaaagacacgtgcatatgtatattcatcacagcattattcataattccaaagacatggaattaacctcggtgcccatcagtggtggattggataaaggaaatgtgacacatatacaccatagaatattatgcggccgtaaaaaagaatgaaatcatgttctttgcagtaacgtggatgcagttggaggccattattgtcagcaatttaacatggaaacagaaaatcaaatactgcgtgttctcacttgtaagagggagataaacattgcatacacagacataaagatgggaacagtagacactgggagctggaagagggggaagcagggagtggtacaaggattgaaaaactgcctttgaggtcctgtgctcactacctgggtgatgggttcaattgtatcccaacttcaccatcacacaatctatccttgtaactacctgcatatgtaccccttgaatctaaattaaaagttgaaactaaaaatgagtaagaatctgaaaagaggaggagcaacttctcacttcagggaagctttcttatgggagtatgttttatacacacatatacatggtatgtatatatgaatctgttttatgaacatacacctatttccttacggactatgaggacaagaaaatggtgtttccctcgtcaggtgactgggctgctacttggatttatgtttggtaaatatgttagtgtgagataatgtaccatacgcctccagaaaccaattttttaaacaatctatagcaccataaattagcattttctagtgtgactttcaaatattaattactattctctgaaaaaaagtttcatgaagagagttcagttcacagagtccaggtacatgtgagaaactgccgagtaggttccttcctcaaaactctgagaagcactgcaatagaaaaaacatttgattttgcttaaagcaattttccccatatttgacaacaaaaccatgtctatttgctttttttctcttccaaagtcaagctattgacatatttgttctacagaagacatctgagaagatttttattaaaccaaataaatgagtaacatggaaaatttgagcatcatagtgggattagagaaacatttttggcaggggatgggttgtgggcaaccattttattattccatttagcttggtttactcctctatttattgatgtctggtactgtaagtgtataattatttagtgttcagtaaatgctaagccatattaaatggtaatggtaagattaagcatgtgcatgctatttgtccaatctagatacaggctaggctcaaagtatgatgtaacttcagccatgctgagggttctataggctttaatattcttcaaagatgttatcataagacctaatagaactagaaacagaacatgaataaaccaatatgactgtattggagatttttccgattgtcaacaagtgtttcgttgactgttccagacttttaaaagtgctgtaacttcaacatccgaatctcctttttgtgtgcataataaacattcctgctttgtgtaattttaactagaccaaacgatgcttacacttcccagataccagctgttgaagcagcaactttcaaatgattttgcagatcggcaaacacattatatcattgtgtgttttgcagctgtctcttcagttagcctggttttgctttttgcagagtaacttgtgtacagttacagaagagtatttgttttcctccaacagtcttggcaattagtgctttcctagcttcagttttactttggtgcaataggcaccctgtattgtgaaccgtttataaaccaaggtaatgacttgtgggtttttaaagagtgcttactgcaccaaaaaaaaaaaaaaaaaaaaaaaaaaaaaagctttctcctggcttgagtgattttaaaaccgtttagtcaaatgtttgagtgcctattgtgtttaaggcactctgtaagtgttttgcatccactgagcaatacatagtagaagttagttgtatcacacgtagatgggaaggttattctaaggaacaccacttttcaaacgcaagagagcatgtccctgtgatgccacagagggaaactcagtgagactagagcagagtacaaaatcagagtatcttatggtaggcgtgcaagaagtagattgcagaaagctatgctaaagagtttgtaaccgaattgaatttggaatgaatggaaatcctttggaggattcttttttttttcagggttatgcgaagatcagatttgtgttcttggtgaaagatcacacagtatagtagagagaatgaactataggcaatcacattgggtgcagggaaacgagtaagcatactattgcctagttatataacaatagattggcaaaactggatagtagagacagtgagtcctagttagttttcttaaatgaatctattagccgatgtacagatattagatagaggacgatagcattttagagctggaaaatccactaatctaagcccattgtccaagatatgaaaactaagtcttgggccaattgaataatcttgataaaagctttaaagctagatagtatcaaagctagaatcacaatccacatctctaaggatactttgctttacattatttctctttttttttttttcttttttttttttgagatggagtctccctttgtcgcccaggctagagtgcaatggcacgatcttggctcactgcaacctctgcctcctgggtttaagcgattctcctgcctcagcctcccaagtagctgggattacaggcatctgccactgcacccggctaatttatctcgctatttttattttgtattttattaactttatcattgagccttaactgcatagattaaaagagtaacttcttttaatgtaattatacattgctaaaatgaggtctcatagcagaagagaaatgtttaatggcagcttcctttacctcttgctacttgactttgagcaatgcattcctttagactcaaaatctgctttttattatttaccagtctcccttatctgcattattcagtgtgcaagtattgatttccacttatgttccagggactgtagcaggtgttgggtgaataatatgtggaaaactctatccttgaggctgttatggtgttggagaaatggacaaggttgtgggtggctctgcaaccacagtggcaggacgtcctgcccttctggggagttcaaaatggctttctggacatgaaacttgattaagagcagtgccaacatcatcgtttcaaattatctggaagtgtacatttaggagcaaatgtacaaagctataaaaatattcataattcttttttacacctaatacttgacccttgtgcttggctctgacgtgcttactctgaaactcttttgaaattggctttgtgtgtagacaacagatgagttctcagatcagaaagtaagtaaactggcatgatgttggattttggctagctctaactattaagtagtgatgacaagggtactcagctctgaagcatttattttttattttagatgacactatcttaatctcaaaaagatatcctttgacttgaacacctttcctcaggtttaagctgtaatcaagttaaaaaaaagtcaaacattctcagtttcaggaagatattactgctgtctaaaacctactaaaacatattttgcctatccaaaaggcaaaatatgtctctgaagggaacatgagcaccttggcagaaaatgaagctatttataaatcttattttctttactctttcattccttagttgtttttattggtcatatttaagatatggacatttttaatatatgtacactcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctttatctcctgagcaggcaaacaaacctctgggcaatgtggtcttgcagctcagaacagcaaagaaaaaaaaatatttaactcgataactgcaaagaagaaactgtgtttcctgggagaggaattattgccaaagtagatgcaagaaaaatcagctctggcagagacaaggaagaattacacatatgtcttaagtttatacttcctagatttctatcacaatgatagtaacaaagatgtgaaacacttcatttctataatatcttaagtaggccaggttcagtggctcacgcctgtaataccaagcactttgaggtggaggattgtttgaggctaggagttcaacactagcctgggcaacatgagtcgtcttctctttttatttttattttttatatatattatactttaaattctagggtacatgtacacaacgtacaggtttgctacgtatgtatacatgtgccatgttggtgtgctgcacccattaactcgtcatttacattaggtatatctcctaatgctatccctccctcctctcccaactccatgacaggccctggtgtgtggtgttccccatcctgtgtccaagtgttctcattgttcagttctcacctatgagtgagaacatgtggtgtttggttttctgtccttgtgatagtttgctgagaatgatggtttccagcttcatccatgtccctacaaaggacatgaactgatcattttttatgggtgcatagtattccatggtgtatatgtgccacattttctttatccagtctatcattgttggacatttgggttggttccaagtctttgctattgtgaatagtgccgcaataaacgtgtgtgcttgtgtctttatagcagcatgatttataatcctttgggtgtatacctagtaaggggatggttgggtcaaatggtatttctagttctagatccttgaggaatcgccacactgtcttccacaatggttgaactagtttaccatcccaccaacagtgtaaaagcattcctatttctccatatcccctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgtgcgtcctcttctctattaaaaaaaacttaattagagattctaatgatacagagaggaagatcaaataagtcaaaacaatactattgagaaatattcaagacatttatgttttaaggtaatttgtttattttgccaaaagcaatacataattatttgatcaagcatataaatctgcttcaatttttgtattatattttaaagtttaatatataacttgaattgtgctactccctgtgaagttttgctaaaatatttaattattattttacaaaatgtattgttttgcaaaatgcaaaatctttttctcagaaagttgagttgcttacttagtttcttttgttggtcttactgatttttttttttttggtcacatattttagactttgtgtggcccagatgataagttatcatttctcataggaaatcatatggcctaaaccaaaataaaacaaaagaataggaagtctgtgagacaaaacatggaagtcatttagcatagataatacctaggaaggcctgaataaattgccattggttacttcttaccagtcctacaagttttactgtttctgcttatgagagtagtcatctaccttccatcatcaatgcaggcatatattggatttaataacatttgctcttttgcctattgaattgtattattgctgacatcaaaactctcctaataatgtttttttttcttttctccttaaaatatcggctctgggaggacacttacccaattttctttcatttaatttggcagtaagatgctaacggtccttttttattgacagaagcaataacaattaatacaacttcagtgcatcattagttgacatgttttgtccatatattgtttcaaatctctttaagaaacaaatgatatccatatttgagttaaatacaatggtagataaactaagttagagatgtgtgcgtgtgtgtgtcagccaatactttgagtgttagaattgttttcctattcattattttttgaataaacaagtaaatgctagttaaagctatttgatgctgtgactgtttagctccttatgcaaaagacaggtcaacacccttggatttgttgagttgactgtgcattcagcattatgcaaagcaatgacccagggtgcatgtcttagctctgaccttaacctgcagttacttctcaatgaagctctgatgcctttgtcaagtacttgtactttatccatagattagctaattttcaagttgtggggttaatctttatctgtgttacctttaaactaaacacttactgttccctaaagcactttagtgctttagagaacatgctggagtgaacctccctgcctgaatctgttatgtcatgacccttcattacagactcttttgaagatgtgaggcagttttatattaagcaaagattatcggagcagcctgctttatggaaagaatcaacccaatgtacatgacatgcaccagtgtttctctttgccaaagggaacacactagtcactcacattagagatggccttaagttactatagtcaaaatactccactttggtctgtattttctttaattcagtgtaaacttttgtggagcatacatctgaaaagtccatgctggcactcagagagttactcttttagcgtatgagacagagtgatatatgttgcacgatatttttgtgtttagaatggtcatctatggaatgagattacagaaccaattttctttaatttaaaagaaaaaaagtatttaacctacttgaaacacatacaaatatgttaaaataaataaaaatagttatttatgtgtatttgcacacacaaatagataaaatattaccttgacatattttattatagcataacttgcatcagtatatgtgtacatatacatattggggcatatttgttcataaattcttaaagtagcctggttatgcatgctctgtcttaaatgagtttaatatgtcattatttcactttgagaaatgcatagttattcacattggtttatcacatatggagttgaaagagtctattttacttctctttcaggatcatacaaatagttcatttatataatcacaaaatggagatccactccatgattggccctgcccattaatattgaattttcatcacgctgttattctttacgtgagttcttaaatataaccctggtaagggctataacatgtacatttgaaaggattataaactgtgatagtagaaaattctgagagaattataggaaagtcttcactgaggactcactggagatagctggggtgtatatctccccttgccctaggaggatatcttgcatttttactttacatattttgtctcagaatgagtaaaagacataccttagagtaggatgcaacagtgttctcggatagcactaatttagaaaaaaactgggattgtaaatgcaaatgtattagagaaccattttgcaaatctcttgcttgtaagaaattccccatatttttgccccatgtcacccatccatggtgattaatactcatccttaagccttcaggttttgtcttatatcaggtattcatggaacaatgtgtgtttactttatctatctccatcctgactgatcatatactgcttaccttcgctctttttagactaaagtctttttcttttctatttatttgttcctctgacactatttttctatgcaattttgtttgagcctttctagtaggggagaataggtctacattattgtttataatttcttgtgatcattccttgattttgcttttagttgtattactgcagttaatatttatgtttactaatatgcatatgcttaatcccaaatgatactaatatgattcattacagtgtacagtatgtcaagatgactggcaggtatctgattcctaagtactataatgagaagcttaggcctatagtacttagactactgttatttcagtacctactacaatcagtagatttttaggcacatttaagagatttatacactgactgaggttcctaagtcactgtttattttatggaaatagaggcaggatttatggatagaaaaaatcagaaaaatgctttttttaacccataaaattagagtaaaataatttttataaatctttaatatttagactttggttttgtagataaattctgtgtttgagaaacaagcctttcgtgggttggggttgggaagcagtcctggggaggaaacataatatcctggcaaatgcggccagtggcctggagagtgccatgcaaattgagaactgagagcagttgtggatgtggaatgaataggggtttggtctgggtgccaagtcaatgtaaggaatgaaagctacatcccatgaagatagtttagtgacaactctggctttcagcaagttgatgaaaagctttattattctaattctgctgcaattgcaggagtcccttctgtctgggggttaagcttacccaagagtgttacttcatttccaagtctaagcattaggttctgatacatggtatgaaattgttaaactctgtggattttaaatggccttttgaaattatctgtatcaaccgaggtgatgttaagatacactgagatcattttcaattaattgtacttcagccgatgttgagagggagcaggtagggaaatattgatcaatattgccatggggtatacattttatatatgaaataattacttgtgtcactgaacatgtgtttgtctcaaagccgtatgaaattgtcagaatctgtccttttttctgacttctccctttattcaataacactcaatgatcttatatcattcttaatgtgagattgacttttgtctctaaggaatgtaaaagttagcctgattttctgtatcaactcatcacaggcactggcattcccatacctctcttccaactgagttcttgcttgcttgacagaattgtgagccccttgcttcctttgacccccaggtttcccaatccactcgaattgacaatgcctttggctctcatttttttatcctagcacatcttgcctttcctgagcttgctgtcctgttggcagctagactgctgtctttgttgttgataggacacaaattgggaaatacagggacaaaaattttaacctgctccattacccaataggtttggttttttaaatctgtatttttacttcatacaaggtaatttgcgttgtgacatacctatatggtaatgactgtttggtgggtattttcaatgttgattttccagagttgtcttagaacaaaagtgttggcattattctgtaggctggtaaatacgttgtgcttccatttatgtggtttcaaagcataacttatgatatttgtccaaatgaagaaatatctttgtttgtttttatccagcaggaacttataacttatttcaataatgaatttttaaatttatttgaccaatatgattaacatattaagttctgattttaacaccaaaaaagaaaaaataaaataggccatataattttgagcatttgtgaattttatggaaatactttaagttttaaagtttttaaataggccacatgtctagtattaaaaatagttcacatgtctattattatttaagtcaaaaattacagaagtgggcaaagatgtggagaaaagggaacatatacatcattggtgggaatatgtattaatgcaacccctattgaaaacagtatggagaaaaattacagaagtgggcaaagatgtggagaaaagggaacatatacatcattggtgggaatatgtattaatacaacccctattgaaaacagtatgcagattttttcaaataaccaaaaatagaattatcatataatccagcaatcccattactgggtatccacccccacagaactaatatgatccagcaatcctattactgggtatctacccccacagaactaatcatggtatcaaaaacacctccattcatatgtgtattgcattactattcacaatagcaaatatatggaatcgtgctaaatattgatcaaaggatgactggataaagaaaatgtggtgtatatgcataccgtggatactactcagccaaaagagaatgaaattatgtcttctgcagcaccatggagggaactggaggccattatcttaagtgagataactcagaaacagaagtcaaatatcacatgttctcacttatatgtgggcgctaaacaatgtgtacacatggacagaaagagtagagtaacagacactggagactcagaaaggtgggaggatgggaggaaagagggagaaaaaattacctaatgggtgcaacgtacactattcaggtgatggttacactaaaagcccaggcttccccactacacgatgtaacccggtaacaaaactgcgctggcacaccctgaatctataacagtgaaaaaaaatttaattaaaaaagtaggccacatgttgtttcagctgatgtttacatggaaaaatttgaatctcccaaggtctctggagagataatggaacttcaaacatttcagtgactgattttataaacgcatatgtacgtaagtgtgtatgtatatatatgtctaacttagcataatcaaaaactaagtcaaggctgggtgcagtggctcgtgcctgtaatccaagcactttgggaggccgaggcaggtggatcacctgaggccaggagttcgagagaagcctggccaacatggtgaaacctcatctctactaaaaatacaaaaatcagccaggtgtgctggcgggcacctataatcacagctactcaggaggttgaagcaggaaaaatcacttgaactcaggaggcggaagttgccgtgagcccggatcgtgccatggcactccagcctgggcaatggagtgagactctgtctcaaaaaaagaaaaggtcaaaagctaagctatatatatgtatatatacacacccatatatagacaaatatatgtgtatttggacatagacatatacgtgtatatatgtgtatacgtatacacatatatacacgtatatatgtctatgtatatttgtctaacttaacatcaaaagtatacactacaattttaaaagattaattacagcacacacgtcaaatagatatgtgttgtgtgttttagacttatccttttatctgtccgataagtgggtattcatccagaagacctaattcacatattaatttctcatcttctcacagataattgttttcaccagagttttaccaagacacttcataattaggagtaaggaataggttttgaacattttagttttgaatcctacgtctgctaattaccagctgtgtgaacttaggataattatctaatggctttaaatcttaatttcttcatctgtaaaaggattaaataatagctttctaataatactaaatgaccctttttgtgagtgctagaagacatcatacatggtaaacacctaaagagtgctcgccacataaggctcattcaatattaattctgttttcgtggatgatggttattatcaccgttgactcaagagtttggcatttttgttttaatcatttgcttcatggctttacttcctttacagatagcaataattggctatgcatcgatctttcctcagaagctagcacatgtcagaaacatagtagatatttaattaatttagggtgaataaatgaagtatgccacttctttacaaaatgccaccagtgggacttgccagatacacatatgatcttattttacttcaatttcatcatcacctgttctaaagcatctgatctcccgcacatgaaaattaagctttttggaaaatcacaccattgcggttggtactgattgctttgcccaaattattttgtcttccaaaatacactgctgattcacatcttttttttcttttgctcatgtagttattgattacttctgtctagaattgcccttgcctgacttacttgtctgattcacttactttttcaaaactcaactccagtattgccttatctcagaccccagtctaggcttagatgctcccacgtcatgctctgcttcacctacttgtcatatgttatgtgacctttcctgtcattaactgattttgtctcttactcatgagattgtattcttttcaaggatgagcatggtttcagtgtctcaattatgaatgttttgccagagagttcttagttccttactaggattcagtaaacatgtgttaagctgaactgaatattgtatatagactgtacattctcaatacagtttcttgacttatattcaaaaggacaatttttatttttgcaatggcctacataaaatgcttctttaatccccttgtaactttgctgtaaaaattgaactcaagagataagtagttttgaggttttgggaaaggaaagaaacaacgatttgattcttcttgaagggtgatctcttgttacatatttttcctatgattttaatgagtgtattgcaaaaaagttctgccggatccttatattttctagaaaatctttatttccttactcctacttctgtgttggtttccttaaaacatgacatttgaataaaatttatgccttaggaaaaatgtatttcttttaagctgtaaggtttccaacatcgtactgacatagattcaaaggagaggttccatgtcaaattttgtacttcaacaagatcctgttccattccagttcattgcatcaggctatagctttcatttaaaattttttctttgagaatgctgtgagtgaaatgtgtggctctctttccataccaggaaaatcctctatagagtagtgtatactggaaagacttataataagatatactactgatttcccatgtctaacatttggttctctgatgtttatgggctctactaatcagccttgtggtaattggttttctgaccataatttgaacagaaaatattactgaattaattgtttttaattgaaggaaagtcaatgtagtttttataatacatttttactaagagggaccaatatcatatgttcccattggaattagactcaattaacctattagtgttagatgcataaatacccatcctcatacccatcacactgagtacttattacaccctacaacttttgtttagagatagcatgcattatcttatttatcaaagtatctgaagtaactatggttatccttattttataaataataaacagaggcacagaaagttcagagttacatttgaatgaaataacatgttaaaaaagtgaaaataggttttaatttttcatcccaagatggtaaacacatgctcataacataggtctgcattgacctctctatacctggaggctgaggttgagcaatttatatttctagaccaaaattctcgaaaatgaacaaaattatattgcatttatttccctgctattcattacataataggaacacacttaatttttgtacatgaatcatgagcatggttcaagatttccagctctgactctaaatacttttccataatcatcctacttctgttccgtaagtgtatacacacacacaaacacacatatacaaatacatatgtatacacctccactcttactactgttctttctttgtccgtggtgctgaaagcaggaagctgttccataaagaataatgacagaaattataacaataaaaggtgctgtacttatcaaccatcaaaatgatgttaatcatatattgtgcataacatagagatatttgtatttcttggtatattaccctaaattctcaatataaagatcaaaagaacttaataattaggagaataaaataatgttaaatattgttagtcacactttgagaaaccaaaggttaaaagactagccaacatctcacagagagctttgaattgattgcagctgactgcaaatatgctgactaattatcatgccctttaatagtactatcttgcctggcttttatgttagcctagggaaaattgtcatggaaaaatgtgaatggctaaatattttattcaaatttatcacctgtcatcaacaactagaaatgtatgagccagttattcacccaactacatgctgtggtaggatgatggcagtgattataacaaaaactactaccatttactgaacacttactgtgatctttataagggtcagctaacttaatctttacttcaacctcataaaaaataaaattcttattttggagttacagaaccttttacatggggagatttagttgcctgttttccttggtattggagcagagttactgttccaaaccagattatctacaccaaagtctatgctcttaatcattattctgtatcacctgcttcattttatacactcattgttggtagctatcaaaattgtaggtattgtattgccatgactgaagtctgtctttatgagtcagtgtgaaacagtgatacaaaaaatagtatatttccaattagttacctcgtgtagatcttccgtgtgaccttacgaaagataccttgagtttaatactatcctaagaaaaataaattcagggtcagcatggtgtctcacacctgtaatcccagtggtttgggaggctgaggtgggaggattacttgaggccaggagtttgagaccagcctgggcaacagagtgagacccccatctctataaaaataaaaatttaaaaaaggaaaataaattcagaaaaaattgtaccacaaagtcatttgtttgcagacaattatgtattgtgtagatataaccagtctttgacagacatgtcacttacactttggaaattattagacttgcctaaacttgtagttcatttagttgatattgctgaaaacaaaacaaatcactactgtgcctttgatgattcttgagaagttcaaaagggaaatacaacaataatttgctactgctgtgccatgcactgcactacatagctcacagaatttacttttaattatcatataccttttgctctctatttcatatgtatacatatatattcatatatcatatttatttttatattcatatataatatttatatgtaactaaaatattatataatcagtggcgaagccaaaatggtaatcagtgtattttgattataaaacattaaaaatattaactatatcagaagttacaaagtgttcaattcagtacaaatgcaatatttgttgcatttatatttccactttttttttgcccagagtgtgtgttttgtagatgttgcagttgttagagtttgtccatagtatttttgaattaaagtacgtcacaaagaaattaagatttttttctcttgaaatattagccatctggctgtgttaggctcatattcatgcatagatgtattgactaaatctaggtgtactttaaatgagaatgttctctttagggtagtgtagtccccacctggctcacttcactcatttgtgttagcatatgttccctgtaggaattcaggtttgttgcttttgcgttatactcaaatgcactaaagcagggttcggcaaaccatggctcatgcggaacagcctatttttgaatataagttaaggatggtttctgcaccattacaaggtaagagaaaagagagttaataataaaaggggatgtgacagtaactatacatggtccgcaaagcctaaaatatttactatctggccctatatagatggctgacctcttctttagagtattttatgggacttgtttattctacactgcctctgactctttgaaaaagattggtagcattattcaatacaatcatggacactagaagagattttttcatggcaattagcctggccatcttgggcaaaattagagcctttgaggctttcatgtttgtttctgtttttttttttttttttttttttttctatgagctaagagaaaaccatggtctataagatatttctggaagcaaaactaataaccccacatggacagctgatttctgtgttacttctgcttttaaagccagattgggcatcaaaggattgcctgaactgttcatttggagctatttgtttgaagctgattagtgaaaatgctaagtgtgagtaagcaatgttacttaaactctaggatttggagagttttttcaccagaggaatctgatttagctgattggaagggtacactgatagatttcttgttagtaggaatttaggaacacaggggagagcaggtttagcaacacaggcatgctgattatgaagcgtggtaccacttacgggggaagaactctaatatctttagagtaaatgagtaaagagggcctggagatgaatttgataatgtatacctcacccaaaggtactaaaatagggagaaacatagcaagtagcattgtgctcacccaaccagaggcatctctagctcaatcagttcagccatgacttctcattggtaatttgatttgaatcataattgatatgatttggccatgtccccacccacatttcatcttgaattctcacatgttgggaggtaattgaatcatggggcaggtcttctcatgctgctttcctgataatacataagtctcatgagatccattggttttaaaaagaggagtttccctgcacaagccctcttctcttgtctgctgccatgtgagacatgaccttcaccttctaccatgattgtgaggcttccccagccacatgaaagtgtaagtccaacaaacctctttcttttgcaaattgcccagtctgggatatatccttatcagcagcatgaaaatggacaaatacagtaatctttgactattagagtagaagacattcaaaagcattttagtgcatcttcatctcatgaacagcattaaaaaaaagcaaataaaatggtcataaaatttaattaatttgcccaaatttgtcctaaagagtcagcattagtatctagatatcctattgcaaatttggggctctttttattacattgtctataattccactgacttttttttctaaagagcattattaaaaaaatcagttgccgattgcttttgagtagcataccgaaagaacaaaggtcttaggattggataatcaatgtaatgaatatttataagactatttgtaaatggattttgactaatacaaatagatctggtagcaatattgtttcataacatatatctgtgaatggtgttttagtatcttaggggttggggcttccttgctgaggactcagctaagtaagaaagccagtgcattatttttggactcagaatagaccaatgtgaaggtattaacaagagtaaagacggcaataagagggttgagctattttagcttttccctcaagtaagttttaacttttgcttaaaaacattaattttaaggatgtctattttgtttttgaggccactgtgccaccaggttatttattaaaacaattaatgattaatttactatttttctgccaatgaaagagctaggattcataggtttaattatggctgtgtcagttgctctttatggaggctttggcaagtaatttaaattctgaatctaacaaatttcctaagaatggattaactagtagttctaggtacatactgtaaagtatatataggaaactaaaatttagataagacatatttggtttggcgagctgtaaggagttaatagttttaataaactgtgttcaggataatgtgagtgtaagatatgttcagctgaaagtaaagaaaatgattaaacaaaaatatgaaataaacaacaacaaaaaggaacgagtaaacgaaaatgcagtccagcagcaacaatatgctagaaagttggaggaaaccctgaaaaatggaaagctgttgggaccagactaatgggaaaaagtactgaaggggaaagttggaatcttttcgaagaaaatgattaatagcatgcacaaagatgtcctggaatgtttatcacatcagtacgagtcatagaatttggaagcaaactttcctttcaccaacacgtcttgttttaataaatcatgatatatcaatactttggaacattatgtagccattaaaatgatgttactcaattatatctattcatatcaaagctgcaaaatcacacttaaattattcaataaaaatttatttagccccttctaggcattggacactattatgtgtactagaggttcaatgataaactcaaagtagtcctgctttgagtttattgtctattaaatagaaaacagtcatcaggtacatatgcagattagtgagtgtaaagttacaactgtgaaaacattcttaaaagcctcatcttaaggaagtgtgcaaagtggggtctggatctaattggggatttgaatgggctttcctgaaatctgaaggatgaaagaattgagttaactatgtgaaagttagggggtaaaaatttaagggaggggagaaaaaaggtcatatgaccatatggatttttgctccttagaaattgaaataagatttctgtggctggaggttagaaagtaatctgtgaatgtaggataaagttgaatcagaaaaaggaatattaaaaatttgctaggtgagtttctctaagtttcctcatataagcgagatattattcacagaagcagtgagtagaatggtggatacctggagctggagggaaggtggggaggttggggagatgatcgtcaaaggacataaaatttcagttagaggaataaagtcaagagattaattgtacaacatggtgattgtagttaataacaatgtattatatatttgaaaatcactaacagtaatttttaagtgttctcatcacatacacacaataatcatgtgagataatataattgtaatttgttaaatttagcgttatacaaggtatatttattttttaaaatcatgttatataccataaatatatccaattcttgtctttttaaaaaataaaattgctgggtgacaaatattgaatgcttaccgcatgttgaacattaagaatgatcacactaagaactctcaatagcttttgagacaggtatgagtatcatttgcatttctccagataagtacactaggatgaaactaaacccatgtcacacagtactgccagagctagggtttgaatccagactgaatagcaatcactgtgctacactcatcttttgggtaggagatagtccataggtctattttaaatgttctggattttgatttttatcctaaaataagataacaagcattggcaagttgccatttttttgataaattcttaaggcatttgtggggaggaatattcaagtggagagaaagagaaagtaaaggaggccagcgagaaagctattaaataatgcagaggagaggtcatgatagctcgctccaagagggaagattagagatggagggaagaagacaggttgcagagacgcagaacaggtgaaattgcatggtactccataatggacctgctggggtgcaacgtgagaggccgatctcaggtctgtgtggaggatgacaacctgccttgagataggcagcactgaacaaagggcccgatgactatgagtgtgttctttttttttcttattgagtgcttcgaaacacttatatattgaagtcaaaccgcatgaatgtgtgtgtgtgtgtgtgcgtgtgtgtgtgtgtgtgtatgcatgtatatctggaactcagggaagtttactgagctggggatagatttgccaatcatctatgggtagttaggaattagaactatgggtatcaatgaagtttcctagggacatacatgaatgaatagagatgaacataataaatcaagtattaatagtaattatttctctgttataattataggtattctttgtgctagttttctttatttgtatttttgttttactttaatcagcatatattgatttttgtgggaaaaaaattgaaaaagattttttttttcaattgagaagaaaaagtttattgtatatggcaaagggtagaggagaagagaaccaagatggacccggggttttgtgtctggatcaaaaggcttttctcctctcattttgcactgtttaccccactcagtttggcgctaccttttattactcactagcagtatcatttccatcaaaactctaatttttaaatattttttggacagtaatgttagctgttatcagaagttgtcaacagaacttaaattcaattttacttatactttaacatacaggctgcacatgctaaatgcttgtcacttagaatgctgttctcattagtctggattgcagattttgttgtcatgatgatatgtctggcaacattctcatagtgggtgagctcgactgtctagggattatcttctattacagttcagtttatcatgctctgtttgatatgttctttattaagaaacttaattacctatagttctagatattatgtgctaatgagttgtacgtgtgagtaaatgtattccgaactcatttttggctgctgatatatttctacaaagatgctttgagaaaaagaagcgataagatctgcttccattcttggtcagaaaagttgccacttagtcataatgtggctttattccatgtttccatgaaattcatttgagacatagtaaactcatatttttgaatttaatatttgtaagcacactgtcagttatccacatagtcaagtaaaacttagccgtgaacaaaatctttgaactgtaatgtcatattgtgtcaggtaatcttattcagctatgaaatacttaatactttaaaaatgacactttattgagcacttctatgtataacagtgtttagtaaaatgtttattttgactacttactatagttacatcaatttggtatttccagcagtagtcagaggaagcacaatttaattaaatatgtggatggagaaaattgatttcagagcaaagtttcttgtttcagattacttgtttggatctcagattttgcgtgttgttaagggacttacatttgtataaccaattgtaataaatgaagatttccatgaggcatatggttgcattcatttcggaagaactacagatttcaagtaaaacaaaacaaaacacagaaatcactgaaccaaggcacatttattgagtacagacatcaaacaaatctcatttttgtattaaaatctaaaaattccatataaatagctatgtttgtaggttgttctcttaggctaaaaataaagacagatattgcatctttcatcaacctaacatcaagatatttgcgtgggaccaatcttctcaagatttgattttaaattgttgcttagtcttattcaaattgcatgtatccttccctctcaaggtacataaaatgaaatgttctgaaaagacaattatgtgaatatgggagattctagggacttacagactctactaattttagcaataatttttttctcatagtgaggtccattttcagagtacattaaatcatgtatgaatagtcttcatctttcagtaaagaaactgattcttccagttgaaatttaaactttcttttactctctttttcttttttctgttgtcaacttcattgaaatgtaatttgcatacagtgaagttcatccttcttagtgaacagttctgagttttggcagctatatatatctgctgccactattaggatacagaatagttagcccaaactccctcttgccccactttagtcacctttccttgactctcactctttggtaggcgccaatatgttttttgttcagatagttttgctttagcagattgttatataaataaaatcagacaatatgtagcctttcaggattggtttccaaagttcatctaatgcatttgagattcgtgcatgctgtggtgtgtgtatcagtctctgttttcttttaatgcagaatagtatcccattatatggatatgccatagtttgttcagccattttatgctttctttttattctcttttttcaaaattaattatttatttatattaattttgtgggtacataatagttgtatatatttatgagatacatccgatttcttttttttccttttttttttttttggagacagggtggtagtctgtcacccaggctagagtgcagtagtgtgatcgtggctctctgcagcctggaccaccctggactcaaccaattctcctgctacggcctcctgagtggttgggactacaggtgtgcactattatgccttgctgatttttttgtgtatttatacatatattttttgttgttgttgttgacatggggttttgcaaaattgacagactggtgttaaactactgggctcaagtggtctgtgtgtcttggcctaccaaagtactgggactacaggtgtgagccactgcacccggccctatacatggggtacaggagatgcttgatacaggaatacaatgcataccagtcatatcagggtaaatggggtgtccagcaccttaagcatttaccctttctttgtgttacagactataaaattatactcttttagttattttaaaatatagaatagattattgttactgtagttaccctgttttgctatcaaatatagatcttattcaccctatctaactatatttttgtacccactaacaaaacccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtataagtacaacaatttcttcatccactcatctgttgatggacacttaggttgcttccaaattttggctattttgaatagggctgcaataaacatagaagtgcaggtatccctgtgatacactgatttcctttcttttgggtgtatacttggtggtggggttgctggatcttataatagctctatttttagtcttttaaggaacctccaactgtttgccatagtgcttgtactaatttacattcccaccaacagtgtacaagggtccccttttctaaatatccttgccagcacttattactgcctgtcttttgaataaaagccattttaactgggatgtgatgatatctcattgtagctttgatttgcatatctctgatgatcagtgatgttgagcatctattcatacacctgtttgccatttgtagtcttcttttaagaggtgtctattagatcttcgcccatttttaattgcattattagactttttccctatatagttgtttgagctccttatgtaatctggttattaatctcttatcagatggatagtctgaaaatctgttcccccattctgtaggttgtctcttcactttgttgattgtttcctttgctgtgcagaagctttttaacttgatatgattccatttgtccatctttgctttcgttgcgcatgcttgttgattattactcaagaaatctttgccaactacaatgtcctgattcctcagtggtttttgtttcttgtttttgtacagtagtttcatagtttgaggtcttagattttagtcttttatccatgtttatttgatttttatatacagatctagtcttattctgcatgtggatatccagtttctccatcatcatttattgaagagattgttcttaggacctttgtcgaaaatgaattcactgtatatgtataaatttgtttctgagttctcctattctattctattctattctattctattctattctattctattctattctattctattctattggtctatgtttctttttatgccagtagcatgttgtttgttcactatagctctgaagtataatttgaagtctggtaatgtaatttctccattttttcttttcttttctttcttttttttttttggcttaggatagctttggctattctgggtcttttgtgattccacgtaaattttaggattgtatttcctatttctgtgaagaatggcattcgtattttgataggaattgcactgaatctccagattcctttgagtagtgtggacattttaacaatattgattcttcgagcccatgaacacggaatatctttgtatttttcttgggtctccttcagtttcttttatcaatgttttacagtttttattgtagaaattgtttgttctttttgttgttgttgttacttcctagctattttattttatttccggctattgtaaatgggattactttcttgatttctttttcagattgtttattctgggcatatagaaatggctattttaatgttgattttatgtcttgcagctttactgaatttgtttattagtttgaatagtccttggtggagtctttaggtttttccaaatataagattatatcatctgcaaagatgatttgacttttttctttccaagttgaatgcccttcagttctttctcttgtctgattgatttagctaggacttcctactttattttcattttgtaggtagtatttctgccatgaacactaggattatattaacattttaactagttgctgttgtatctacttttattttattttagaacttttccaatgagttgttatgattgtagactttctaattgaagagctttttatttattaaattatttgtaaacatttcaattgtaataagtattgcatttaatgaaaaatgaattgctttagaaaatattctattaaaattctagagatatgttaatgatttatttgttgtattttttggtatgctttttccggtaaaaaaattaattatgaaaaattggaaacaacagacacgtataaggaagaaaaatccatagtattctaacatggctcatagtttgctggaaagtaattacaaattttttcagtctctaatatctgcaatatcaatctcaaagattgagaacttctggcacaccatagttggaaattttaaaagtaaagccaaaattagctaatttagttaagtgagttaggggaagcaaggtgaacctatggagtacagataagaaaacacacttcagtgttcaagacatcaaaaagaaaaaaaagaggaaagaaaaatatatttcattatttgaactagattacattcttccctggagttccctacttttgttatcctgcataactgtgttttaagtagggttaaaactaagatatttcaaattctgtagtagaaaaaaaatagtctggtattatagattaaaaaaatgaattaaatataattattaatctaagttatgaagcctaaaaaattctaactcatttgtttaaaacacgaatgtccatattcttttactttattccatgatatatgaaagtataatagcatgcattctatttataaacatctatgtttatcttaaggtacatatgctaatgaacatttacaaattgcatcccttacattttgctatgaagaatttaaagcacatactttacagtttgattcatattaatacttaaggtctttttcatacaagttgtacctacattaaaaattagaaggggtcttagaagtcatcttagtccaagtaccttatttttctggagaagaaattcatctcttaaatggttagtgaatagaaaagtttaaatagatacaaggatccctagtttcaatacaaaataatttcgcctataacatcactgggatgcaatgaatctcaccaaaaataattttctatatgtctgtttgtaacaagcgttagcccccaagtattttaatcaagaagtagcgatatatgaaagaaatccagtcttgtggttcactcttttctgtgactctcaccatttccctccctctatgctcccaccacagtatttgggatcagctccaccttatctcttgtcaggccagtacttctcacaccttagaggatatgagagtcatctggagaatcagtaatgagcacaaattagaatagggcctgggcctgtggatttgcaccaacttttgtgggtgagttttatgccccctaaagaaatcactggtgtagactcctgcatgtgcttccacataagccccttcctctccagcctttctcattcgtctcgaatcaagaggacgtactttggctggcacaagccttctaactgcctagtccattgtattgttccaaacaagttaatggcatgcactgaactgagacacactttccaccttggcatcggaaggctcccctgtaacattctagcctgggtctctactccagcatgactgaactccggccctttaagaggaagcattaaaagtgtgatttctgttctcagaaacttgagttaagcttatagttactactaagagaaatgttctgagcttcaccatttttctggaaaaaaaaaaaggtttttaggtgctttgaatatgatacataaaagctgggtatgggggagaaggcacttagcaaacttggggatgataatatgataggctggtcacctttctgtttaattattttgcttacaatgtttcactgaccataggttttgaacttatacatgcttcaatcttcagttttgatttcactacttccttgtgccttctgatttcccttgctgtgtgctttcttactcttctgaacatgtatagagttgtcatatagccactggaaaaaaaattctgccatatatgagtgctcgtatgcattctgcattatcctcacacaaggcaagggagctgatttcatttccttttgtaatcactgcacatgacaagttcccaaaatacatattgaatgaagtcaatgaatacacttattttgaactcttaatctttataaacattaatattttctggtaatcataataacagctgctgtttattcagtagttaacatgtgccagccttggtgctaagtgttctgtgtatgttattattatgttcttagaacaactaccccgagatgcaagtattttaattccatttcatgtatggggcagtttgaagctcagtaaaaaaataccttaatcacttgcaatagctaataaggactagagttgagaactaaatataaactcctagcaactttatcgatagtgtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatgcagtcccgtgtgtgattataagacctctttctcccttccagtctttccctggttcagaaaagacttgactccataggcatcatttggagctggagaagacctgttcttttcccatcgccttcatgtgctccttgctttccccctggtggttctactttatagaggacattcaaatgggagttcactctgggatccattggatagtttttcttagggactctgggtctcccctagagtttcctggaatgagcacttagtctctgcaaagaaaaattgacagcagagtctgccacaataaaaatttctactcaagtttgtagccctcttgtgggcgtggacaggatgatactccatagaatttccacagcatccttttcactcatggaaaactcactcacctttgccacaccaaatgtgggatgcaggcttttccccatcttccacacacataccccatttctgctcacctgtctctcccttagcccttcttctgcccagtagtatcaggtggatttaaagcttagaaagttctagaactaagagataaatcagccttcaaaacagtaggaagttaaatggaggtagtgggggaaatgcttttcaaggtacctttatcttgaagaaagggacattttaataagcaatagaataatgatgaagaagtggttgtattccctcaaattcacttattcccaagttttatagatctgtgtttattatattttttctgcagcccacacttagaaataatttttgcattacaatcaagttggctctctctccctctctctccttttctcacacatcacatacctgaaataataatagtaaactcagcattcacctattttatataccctgcactatgtttccttttcttcttctatccagtactatcagtgtttaacttgcttgtttcgtgacccacaaaactgattagataaccttaacctttgcatgcgtcacgtttcacaatttataaagcactgctgtagaaggtaaagactaataaacgtgttggttgacctttcttcccttgtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggtagctgtgtatgcatgcacttacatttcctaaaccagttttattgtttttcctgaacatacatgcttgttgtttaaaaaaaactgttctgaaatatataattctttctcattcctgcagagtaatcactaattcaggtcttttttaagtcctacttaatacatataagcacccacgcatgcttatactttagtagtctttttgtttctatcacggtcttgtttattctaaaagttgatcattggagagaaggtgaccttgacatgaaagtcggctcttgcttcaaagtctaaactgggacctccttgctgccttgaagggtaaatttatgatctctctgggataagaacatgatctttagactctattaacttttatccaacttctttctcatttaacatgaaaatgcttaggtttttgtttttaaccttgttttttagctttcattgtgcacttgctgatttcgttctcagtgtgacctcttaaatatccaaagggaaaggaaaattgctttagaaaacctctgtgcaaggaagttcagagaattggacttacctttgtaagaataatatgagctggatatagtttactgggacacaaaaatctgcatataccaagggagtgggacaatagacgtaatgatgtgaatggtaaaaataataaagaggactttgcctcatttattgattttttcaagtattttccatctgagttactgagtacagatctcttcctttcaatttacaaaaactaaaagaactaaagataggcaattatttgtggtacagatgcatttacaacaatataattctgttttaaaatcaagttgccttactcatttcaaagctaaggttgtgatggcatttctggaaattctccaatttatcttaaagttgacagtttttttttgtttgtttttttggtgggggtggtgggtgtggagaccgagtctcactctgttgaccaggctggagtgcagtggtgcaatcccagctcactgcaacctccacctccctgattcaagcgattgtcctgcctctgcctcctgaatagttggggttacaggtgcatgccaacacacccagctaattttgtatatttagcagagatgggatttcaccatgttagccaggctgatctcgaactcctggcctctggtgatccacccaccttggcctccgaaagtgctgggaatacagacatgagccactgcgcagccaagctgacgtttcttacagctattgcctcaaataagtacacgatggaggatgtccttatggcttaagtctgcctcatagacgattgttcagtgaaacacttaaattactccctaagtctcaactctaattccttaggtcataactaaaaaatttacttttggctaaggagtgcaagaaacagacaagcaaccaaaacaaaacctatacatactccccctccaaacacacaccaagattctctttaatattcattatgataattgtaaccatataaggagttctttttgcgtgtctgacagtatgctatacattgtcactaaacccccaaagaaaacttagaggtattattactaagttacagataaaatttttttaaaaagatttaagttgttctaacgtcacgttggtgaagattttaacccatctttcagaatataccatggacatagttgtcaggcaagcaagttagtgtagagatgcctttcattgtttaatggtaggtgctcttttagatgtctggtaggaacccaatagttatcttgtttattaataataacaggatcaagaggggaagtcattttctttggttctcttatttccaagcaacatttctgcattagtaatgaactccttaaacaaacactgaggattcttattagctttctttttctatggcaaacattattaactgatcacggcatctttacactggaagggctgggcagcagaagcttccacagaaggctctctggccagacaccaccaatcaattattgaaggtatcaaaattaaaaccaatgtgccatttctgcctttttctatcctatgactctcttacactgaggattagaaagacaattttgaatttttcacttaagtcttaagagacatgttgatttgcaagaggtatttatgaggtgttatgcagagtaagctagttaactctgatatcctctctcatggagactaagtaagttggctttccctgttaaggaaaatagtgttaacatctgcatttcacagtgagttaagaattttcgggaatggggcattacatttacggcctaggttctgaaattgtacatgaacaatttgagctcaaagattacaatgttgaaaatcagtgattttctaacagctccttaatgtatagcagcagcaacagccatcacaataataatataacttttccaggttcctactatgaagctaagctctatacagacaaagcttattttattgtactttgtgttattgtgctttgcagacaatgcattttttttttccaaatgaaaaatttttggcatcatttttgcagcagtatatgcctaattcatgtgtttgggtcacattttgggaaatctcagaatatttcaaattaattcattattattgtatctgttattgtgatctgtgatcagtgatctttgatgttactctcataattcttttggagtgccatgaaccatgtcagtataaaacagcaaagttaatcaataaatgttgtgtgtgttctggctgctccaccgactagctgttgccccatctatctccttttccgcaggcctccatactccctgatacacagcaactttgaaattatggcaattaataatcctatagtcacctctaagtactcaagttaaaggaagagtcacacatctctcaatataaatcaaaagcaagaaaagattaagcttaatgaggaaggcatgtcaatagccaagacaggccaaaagctaggcctcttggttcagttatccaagttgtgaatgcaaaggaaaacttcttgaaagaaattaaaagtgctactccagtgaatgcacaaatgataaagcaaaacagccttattgctgatatgaagaaagttttaatggtctgtatagatcagagcagccacaacattcccttgagccaaagcctaattccagagcaaggccgtaactcccttcagttctataaaggctgagagagatgaggaaattgcaaaggaaaactttgaagttagcagagtttggttcatgaggtttaaggaaagacactgtctccataacatcaaagtgcaagctgaagcagcaagtgctgttatagaaatcacagcaaaccggttatccagaagatgtatctgagatcattgctgaagttggccacactagacaacaaattttcagtgtagccaaaacagccttctattggaagaagatggcgtctaggaattttagagccagagagaagctgatgcctctcttcaaagcttcaaaggacaggctgactcttttgttagaggctgatggagctgacagctttaaaatgaagccagtgctcatgtatctttctgaaaaccctaaggaccttaagagttaggctgactgtgctctacaaatggaacaacaaaccctggatgatagtacctctgcttgcagcacagtttactcaatatttttaagcccacgattgaaacctactgcttaaagaaacaacattttctgtcaaaatatacctgctcattaacaatgcacctggttacccaagagctctgatggagaggtgcaaggagaataatgttttcaggcctgccagcacaacattcattgtacagcccttgagttaaggataattttgtatttcaaatcttattttttcaaaagttgattccaaccctcatgaatgactttgagtggctcgagactttagtgaaggaattagctgcagaggtggtggaaataaaaagataactaaaattagaagtggagtctccagaagttcctgaattgctgtactctcatgataaaacctaagtggataaggatttacttcttatggatgagcaaagatggaatttactcccagtaaatacgatgtgaacattgttgaaatgacagcaaaggatttagaatattatataaagttggttgataaagcagtggtagattgtattagtcagtctagagggacagaactaataggagatatatatgtatatataaaagggagtttattaggtagcattaactcacacgatcacaaggtcccatcataggccatctgcaagctgaggagcaaggaagccagtccaagtcccaaagctgaagaacttggagtccgattttcaagggaaggaagcatccaacacaggagaaagatgtaggctgggaggctaagccaatctagcctttttatgtttttctgcctgctttatgttctggcagcactggcagctgattagatggtgccccccccagattaagggtgggtctacctttcccagcccactgactcaactgttaatctcctttgacaacaccctcacagacatatccaggatcaatagcttgcatccttcaatcaaattaagtcgacactcaatattaaccatcccatggaatttgaaagggtagactctaatcttgaaagaagttcaactgtgggaaaaatgctatcaaacagcatcacatgccacagataaatactttgcaaaggaaaagtcaatcaatgtggcaaaatccatcgtcttaatttttgaaattttcatagccaccccaacattcagcaaccaacaccctgatcagtcagcagctagtaatagcaaggcaagttcctccaccagcaaaacatttagactcactaaaggctcagatgattgttagcattttttggcaataaagtgttttctaattaggatatgtccactttttttagatgtaatgctgttgcacactagtagaccacagtataatataaacataacttttttttattatactttaagttctgggatacatgtgcagaacgtgcaggtttgttgcataggtatacacatgccatggtggtttgccacacccatcaacccatcatatacattaggtatttctcctaatgctatccctctcctagccccccaccctccgacaggccccagtatgtgatgttcccctccttgtgtccatgcgttctcattgttcaactcccactaatgagtgagaacatgcagtgtttgattttctgttcccgtgttagtttgctgagaatcatggtttccagcttcatctgtgtccctgcaaaggacatgaactcatccttttttatggttgcatagtattccatggtgaatatgtgccacagtttctttatccagtctatcattgatggacattagagttggttccaagtctttgctgttgtgaatagagctgcaataaacatacgtgtgcatgtgtctttatagtaggatgatttataatcctttggatatacacccagtaatgggattgctgagtcaaatgatatttctggttgtagatccttgaggaatcaccacagtgtcttccacagttgttgaactaatttgcactcccaccaacagtgtaaaagtgttcctgtttctccacatcctctccagcatctgttatttcctgactttttaatgatcaccattctaactggtatgagatggtatctcattgtggttttgatttgcatttctctaacgaccagtgatgatgagctttttttcatatgtttgttgaccgcataaatgtcttcttttgagaagtatctgttcatatcctttgaccactttttgatggggttgtttgtttttttcttgtaaatttgtttaagttctttgtagattctggatattagcctttagtctgatgattctggatattagctctttgtctgatggagagattgcaaaaattttttccaattctgtaggttatctgttcactctgctcatagtttcttttgctgtgcagaagctctttagcgtcagcatgacttttaaacgcactaagaaaccaaaaatgtatgtgacttgcatcatcacgatatttgctttattggggtgatatggagtcgaacccacaatgtcttcaaagtatgcccatactaagtacccactccttatacactcaattttcacaacaatcttgtaagataattttattctttataagtcaaaacaaaatatttacagttcaggcttcagtaacttgcttatcagcaacacagctacacttctcaactgaataccaaggctgccttttcctctaaagttgtaatgtgacatagtactaaatgataccagagacttttcatggcaaacctataaaaaaagtagtgttggtcgggcgcagtggctcacgcctgtaatcccagcactttgggagtccaaggcaggcagatcacgaggtcaggagttcgagaccagtctgaccaacatggtaaaaccccgccactactaaaaatacaaaaattagctgggcgtggtggcaggcacctgtaattccagctactcaggaggctgagacaggagaattgcttgaacccgggaggcggaggttccagtgagctgagatcgtgctactgcattccagcctgggcgacagagcgagactctatctcaaaataaataaataaataaataagtagtgtttctaatatctctcaggctgtctttaaaactgcatgtttaaacagtttgctagactaatatgttcagtatccttggtagttgtaagtttcttgtatcttctttctttactctttctctgcaaaagcataatccatctcattgctgatattctcagattctaatctggtacaggttaacaatataaagcagtatgcacttattcacaaaataatatatatttgtagattttgtgattcacaataaatcagtaatagcatattgctctctctctcccctactggccttggtgatagttgttctgggaattctataaaccatggcatcatcatgagagagacacacaggctttctttctgatgttaatcaaaccatttctatttcttcatagcttttcattagatggattttggctttatgtaatacagaaacacatcttacttttaaattgaactgtatgattttaatttattcttcatctttgctaattgttttactttggtcaaatctgaaaatccttctatacctcagaaatgtatctggaaaaatggggataaacataaatcacagggttatcataaagattttaatatactagtgaggaattcctttgaaattgagtatgcattgactgctattgttattactagaacgacttggaagtggacatgaatcatttttaaatagttgtttggtggtacagtttttttaaaaaaaatttctataggtttttgggggcaggtagtatttggttgcatgagtaagttctttagtggtgatttgtgagattttggtgcacccatgacccaagcagtatacactgtacccaatttgtagcgttttatccctcatgctcttcccaccctttccccctgagtcctcaaagtccattgtatcattcttatgtctttgcatcctcatagttgagttctcgcttatgagtgagaacatacaatgtttggtttctcatccctgaattacttcacttggagtgataatctccaatcccatccaggttgctgtgaatgccattaattcacatttttttttcttttatggctgagtagtatcccatcatgtatatatcccacagtttttttatccactcatcgattgatgggcatttgggctcgttccatatttctgcaattgcaaattgtgctgctataagcatgcgtgtgcaagtatcttttttgtataatggcttcttttcctctgggtagatacccaacagtgtgattgctggatcaaatggtaattctacttttagttctttaagggctctccacactgttttccatagtggttgtgctagtttacattactaccagcagtgtagaggtgttcccatttcaccacatccatgccaacatctatttttttttttttttttggttatggccattattgccagagtaaggtggtattgcatttttggttttgattggcgtttccctggtcattagtgagattgagcattttttcacatttgaaaacatagcttagctcccacttataactgggggccatttctatattttcttttaatttttaaatagtttaaaaacataagcaaagctatatagtctcatattttaacaactagcttgaaagtatttaatggaaaaatttatattagtattgcttatgtaaacctttattggtagttggtgatacttctatcactcatgttaaattctcttctcaaataaattatagtgttttataacacacacatacacacacgtgtgcacctaacatttgttgtgatttgctaagtactaggcatataatttgcctcccaatttattacaagtaaggtttatcaaatattttaccactgcataacatggaatatcaccttgccagcctccaatagtatttccttgacaccagctgcctgactgctaaggcgttgacaactatttttgttttaattgtagcaggatcccactcttggtacttgtttaggtattagggtgatttcgatgggcccattaaccctactgactgagcatctcagtggctcaacacagaaaagatgcatttcttgcccatgctatatgtctgaatgactgttgattggctgcaagtcaacagttctaaaataaaactatgcttagctttaaaaaaataaaataagggtcagtaaaatatctagttatttttctttatttttattttctcacattttcatttaattttacattattttataaatataactgtacaaactgtaaagccagttatttgctaaagagttttttgataaaacaaaatgattgagtagaaaatctcaccatgatctttgacttacttaatggtagttacagaaaacaatttatataaattaaaaggccatacatagtccaagcaaccaacaagtatttgactcatacaaatctgtatcatgatgtccattagctcaagatgttgacttttcttctttttcttcttgctggtttttttttaaactattttttttttcatctagccaccagagaatgcttatgggaagttaacataaatatcaaacagtgttttcaaatattgtttatgcttgactgaatagggatttgcacaaagagtggttaaatatatggactaaaatagatgctccccattataaaataatatttggtagattacttataaaatttttcttgttattttgaaacccaaagttgtttatatatatagtcctactttttagatttaagccttttttatgtgtttgctattaactgacttagaaaaagtaataccttaaaataagaaaataaatgcttaggacaataggtagattgaaaattcatttgaaattaaaaaaaatctgtgacatttatttttgtgcatattagttccagaactgaaaataaagccctggcagtctcagtgtctatatatatatatgtgtgtgtatatatatatatatatatatatagagagagagagagagagagagagagagagagagagagagagacatatatatgaatgatatgaatgtgtactatgatacattggcctttttgaattacttttacaattgctatagttaagccataatcatagcaaaatatttcaccaagatgaaaggaatataaaaatgtttctggcattataaaaattgcagtgaagaaattggaacttaaagccaaaacaaatagcttacataattaaaacagagctttgtctgtggtaaattttttggcctggaaatgtgaaatatttcttaattcttgaaagtaatagttgtgaacacttcataaaattatagtgagagagagaatgtgctgtaattagcagctgaagagataaatagaaaatcttgcttagtcgtgtaccttacattttcatcctgacaatgctgaatacattttaatgagaataaaataaattaaaattaaagcatcagcatagattctatatatactgtttttccaatccacattccaagagtacctctgtgtttaccattgctatatatatatgtgtgtgtgtgtgtatatacatgtgtatatatatatgtatgcacatatatatatacatatatatataatttcattagtttgggggaacaggtgttttctgttacatagataagttctttggttctaatttctgagattttggtgtatctgtcacccaagaagtgttcagtgtacccaatgtatagccttttatccctcagctccctcagccccttccccccgagtctccaaagtccatcgtatcattcttatacctttatgttctcatagcttagctcccactaataactgaggacatgtgatatttgattttccatccctgagttacttcacttaaaataatgatctccaactccatttgggttgctataaacgccattattttgttcgtttttatggctgagtggtattctatggtgtatatattccccatcttctttatctattcattggtgaatgggcatttaggctggttcgtatttctgcaattgcaaaaacaaataacctcatcaaaacatgggcaaaggacatgaatagacaattctcaaaagaagataaacaaatggccaacaaacatatgaaaaaaaatgctcaacatcactaattatcagagaaatgcgaattaaaactaatgagataccaccttactcttgcaaaaatggccacaattaaaaaaatcaaaaaataatagatattggcatggatgtggtgaaaagggaacacttttacactgctagtcaaaatgtaaactagtatagccactgtggaaaacagtatggagcttccctaaaaaaccagaagtagaattaccgtttgatccagtaatcccaatattgggtatctacccagaagaaaagaagtcattataagaaaaaaagacccttgcacatgcatgtttataccattgcttttagattttactttgcagacttgtaagaattctgtgatacaatgggaatatgttacttttgttgctgagttttacatgatagatttctgtcatataagtcagcaataaaattaatgattaatgattcttatgacctccttatatatatcttaatgagaccaacattaaagtttggcattaattaaattctgggccaaaaaatatattatttcagacgcagcttgtacatttttttaaattgacttttgagctgatgttaggtttgattagaaaaacatattcaatgagctccaaaagttgtgcttatatgtgatgtcagaaatatccggatactgaatacagaaattgaaatgaaagatggaaacctgaagaagactacttttgaaatagagtgatctaatttttatatttactaccttcaaagcccacctctcactgtatacttttttggggtaaaaaaaaaatgtgcacttcacattcccagttatctacgaactgactagattcatttaaattcattacatagttatcaaaccttcactacgttacaggactgtgctacatactggctagacgacaataatgaagctcattgaaaatatcattagggacacacataatttgctgagctttccaccaatggaattacctaggtgctctggtacatgaagacaaactttattctgcctggggaaagcactggggttttccagaagaggtcatctttggttaagccttaaaagaattggtggattttttcaagtagaggtctttctgagaacactgtaaactgaatgatcagtgtgaacaaatgtatgggccgtaagtggcctcacagagacaggagaaatgtccactagttgagtgtttattgtagcatctgggcgaagtgtgaagagaaacagatgagcagtgtgtcaagtagggaggagaggcgacagaacggagggaaactggaattgtgaggattcagtgtatgggacacacacagatgttgttggggcggtagacaggacttgggaactagatttgaactcttattttactatatgtatacttattttacccattattatacaatgctacatattctgatagtaaaataagtataaccacatctaccatgttcacatcttgaagagggttgaagaaaatcaaatgacgtggcttcgaagtccttcctccgaaccagataggttctgctcagtgagtgagggtgtatttgcctagacatgcaaatgaatgaatgagagaagtgcacgagaaaacctactatcaccaaagacctacgtcagttttcccaaacagctttattagtaatacagctaacatttaaattcaaaaatgataaaatgaggagaaatgcttacatttgtcatttgtattagggatgagtgactacaattgggaaacagagaggaagacatttttgtatttgaattgttgatagatggtaatgctaagaacaggataaagaatggaggagaaaaatgaggagaagctggggagagacttcaggtaggatctactgtttttttacagttggtgaggtgcctgcatgtcctcatcattgagctacaattttgttttgatgtcaaccaaggtgtaaaaactagatcatccgtatacaggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgagaaagggatcattactcttgccccaagagagtcagtggtgtcttgcattgagtacttttcagtggagtggctggagatgaaatacaattgcaggaaattaaagaatgcatggaggtaaaaacaaagaaacagaaatgcagtctacactttcaagaaggttgatgatgatggaaagaaatgtgtttgagaataaaacaccccgtgaaagattagcatgcaaagacaacacaacaaaccaatatactgttttgtttttccctttggtcctattccaactagctaatggtggctgtatagccttcttatatgactcaccatttagtttaggttttctgtctccagggagagcataacatggtaaacccttggaatatcatgtctcctttgctagttttcttctttccagttcaggggattgcagtgatattttccatcattgactgcagcaaagatcccaaaggtggaaatatgcctccctcaaaggtactgatgtcatctccattaggaggaatttctgtataatctcactaaagacaccatgaagatttgtcctgtgttttcagtgtctgatggatgctgctgtaaggcagctcttagtttttatttgcacttttatgctttaatgcaattctccctctctctaggactcaagtatgagtcccacaggagaagggctggcagaggcattaagtgctagaccatgagctgtattgcatcattctttcattcagacctggctcgtggttttaaactatagttgtatactctggcctctttttctttagaagatatttctttcttttttcttttttttaaggggcctctctgactatgcttacagacttctttttctttgtgagtcaatcctgcttgcccatcacaagtactcagattaggctaccaattggagtaacctgctgctacgttagttattacagagggaattgtgttatacagagggaataagttatacagaggtaatgatgaagtaggtaaagttcaaattgctgttctcttgcttttcattgaataagggagggagatggggtaaagggtagcaaactgataatggaaaggaagagtggtgctactttcattaatatctaaaaagcaatagccgacataactgtcttcatgctaaaatcaaaagtgtaagcaatatgataattcttaatactgccatgtgcagatgtaccaatcatgcttgtgttaatgcaccatgtaaccgagaagatgaagaaatcaaagacatgtgattacatccaaagaccaggagaaaatcacgatagtattgaggatactttcaaagtaagtggctaaggaaaattttgctacatctttcatgaatgtcacagaaaaagagacagtttgaaaatggaaatttttccaaatcttattgaagttttgctagtatattttactgagaattgagcaatgatttttgagatcttcattatgctgaagattaaaaataccaagttgttgtttctaaactcatttttttcagagaatagatagcttttcagcatttaatatgtacaataaattgcactgtggcgatacacagatgaatctgacacagtgtctattctatttaattaatgtcctgatataaaacgcactttagaaaacattaagcattataaggggtaaattattgaaggtgttcaaacagattatgttcatatatagcgattaggaaaagccttgtaaaaattttggcattagttggacctttataatagatagcacttagaatggcaagagaaaatatggtgccttccaaatagagggaaccacataaatcacgtggtagaagacacaagcaatgaacatagaatgcatggcctctttttattgggtcgagtgattttatgaaagaagttaagagaaatgaggttgaaaatgcagtttgaggcaagtcatttcataccataataaggagtgtgggttttatctgaaataatttcattgggtaactttaaaacaacttgttaaatgatctgatcggaaattctacatagaagctactgcagatagcaagccttttgagttctactttttttcccctttcaacaacttctacgtaagaagaattaaagtccacagactatcagaattaagggaactttgattttcttcctcaaaatgatgcctactgttaagtatgaaaggttaaccttactccaggaaaggaagagtaaatctatggggtcaggaaggctgttgtggtgaatggataacttaatgaaatgatcaaatagtcctgaatgatgttaattagggcaattttgtattactataattgctttgtatttattgaattattgcaatgggtgagttactagacagaaagaaatctatgcagtacgctgaccaaacactgaaaggatgacagaattggaatgctcttggctgttcaattcactgcttaagcagtctccaaatacattaggctattttttttctttttctctttttcttcttgctcattatctgctcattgtccttggatgggacagttccttatttgagagtatatcacatgttcagatctttttcatataaactttcctggcagacactgattctacaagtgttgtacattgtttaatgattttgtaaaacagatatttactgagagactgcagtaagacagactcattacccaagatcagtgaacccactgcatgcaatagatgaggaagcttctctcccataattccgaactgaaatacaaatgctgcctttagtcgcagaagttaaaaccttaaaagtttgtgttgaatagggaatgtcattgggggacatatcgaaccatgtgttaagatgtgtgaatggaagggtctggagaaaagagagaagattggaagagaaatgtatgggtggtacatgtagggaatagggactcaaagggaatgtctgagcaatgggagacactgtgaggccatgggatgtggcaatggcagcctcagctcatagtacggttacattatttattctttttagttttccagaaaaaaaataatattgccaagtatgccaacctaaataacaactcatgtttcaacactgtattttctaggttgttactggcaacttagaaagcctttactttggaaagagtgcttgagtggtattgaggttcccacattggcttagcaaagtcttctttgataacttacttctagaattatattaatgaacagtagtaacttgctatttcaaacatgatctttatggggaaatgtgtactgaactccagtaaaatgacaacagcatatatgtccacaccatgacagtcttttatgccactggaaaatgttcagaagtggaggcttcctgccagcagtagtggacagaagaatgaaagtaagagtcagattttttggaaaagcatttcatagctttcgtccccggtggctttggaggaatatgccacttctgttactgtgggaagtgcagtcagaaataatagtaacagtggtagctgccagggataggtctgtggactttgggaactgaagtacttgaatttgctatctttatcttgattggaatctatgactattttaaacactttctccaatttacaacggcttctctaagaaaagcttcacagctttctttcagaaaagctttgagaggtaggtttgattggcctagttttattaatgatggctttaaagcatattgagattgaggctgtcactgccaaacatagcacctctctttgtgaggccctatttctccaacatacacatttctcactctctgccactttttcagctgtccagtttctctgctgatctgtaaattcagtcatggaggaagaataagcttaatataatcttcttattagaaagcttttactgcgacaaaaaatccccaggatcttagctctaagtctcttcaacccctgtctataggacctacgtaaagggcaaaagtgtaaaataaataaaaggagataaaatgaggagaggggcaaaaacgaaagaattacttattaggaaaagtaagagaatgtgaaaaagaattatttgcaatgtcaaggtttacatacttctccaggtcaagtttatttttctccaacattattaatgatttattgaatctgaaccccaagcataattctgttctaggcagtgaggagtcataaatatgatagaaaatgttcttaccttcagagtggttacaatgtgatagaaaagtgtatatttataaaatattctaagttatttcaaaatagaattgagaatgtgacaaaagcataggctgtagaaaaaatggttttaggtagattttctctgggcagccccaccttccagtatcagtaaaaaacctgtgttgaaaattgctaccagacaatctctcttgttgagcatgtctaaaaaagtttcatgcctatcagttttgtattctatcacatatcagtatggtgcccttaagcagattccaagaggacctcctcaatcggaacatatcgcctcataaattataggattaatttgttttaaagatgccaactttctctcttattcaggaatgctttttttctgaaaatatacttagaatcttagtagatactctcgtgaatttcatgactaattctaatttgttcaataaactgttgattaaattacataaaatttgggcacactggataataagtacagagaactcatccctgtcccttcaaccttgctgtgggagccactgttcttaattttctaaataattccagtgagtacttttacttaaattatttgaataattccacctgtgcaaacctgactgcaatgggctgttaacctagaaaccctgagtattagattatatctgaaataattgccaagcttattgtttagtttaaccctagtttaactcagatataccaatgcctcattatgtttgttaactctattctgattcttcacatatgattaattatgatttattgagaacatcgttttccctctgtgtttactacagtccacagagtctataggagcggaaatctaatgggtttggtgttcactggagttgttcctttgaaataattaaggctttattttaaacttagcaatagggtaaggactgccagatatttctttatgtacttgaataaaatttgcttaaattcttcaaatctctggtctcaaactaattgatttctctgatgcagtgcttccttctcccaattgtgtgcctttaaatgaaaaatctctcttctaaccctctagctataaggagtttgccaaaggcaaagttgttaaccaagatttttattttgacccatagttccagctttcttttcgttttgacagttaatatgaatatacagaatctcagtgtattaggctattcttgtgttgctataaagcaatatctgagactgggtaatttatgaagaaaagaggtttaactggctctgtaaggtgtacgggaagcatggtgccaacatctggttggcttctggggaggtctcagggagcttacaatcatggaagaaggtgaagcaggagcaggcatatcacatggtgagaacaggagcaggagagggagtgggggaggtgccacacactttaaacaaccagatgttgtgagaggacagcaccaaaccatgagggagccttccctatgacccagattccactagtctctgccttcaacactggggattacatctgcacatgagatttggagggaacatatatccaaactatatcattccaccccgaacctacaatctcatttccttctcacattacaaaatacaaaaatcttgtcccaatagtcccccaatgtcttatttcatcccagcattaactcaaaagtcctaagtccaaagttccatctgagacaaggtgagtcccttacacctatgagcctgcaaattcaaagcaatttatttacttccaagatgaaaggtgggtgcaggcattggataaacatttctgctccaaaaaagagaaactggctaaaagaaaggggccctaggtcccatgcgagtttgaaacctggcaggacagtcattaaacctcaaaacttcaaaataattttgttttactacatgtcccacatccaaggcacactgctgcaaggggttggctcccaagggcttggacagctccacctctgtggccactgctctatcaggctgttgggtgtttttccaagtgcaggatgcaaactgctggtggatctaccattctgaggtctctagggcagtgtcctccttcccccagcttcactaggcaatgccacagtgggaactccttgtgggccctccaaccccatatttcccttctgcacttccctggtagagcttctctttaagggctctgcccctgaagcaggcttctgcctgggcggccaggcttttctatacaccctctgaaatataagtggaagctcccaagccttcttaactcttgtactctgcatgcctgcacgcttaacaccaggtgaaggccactgtgttggtccattctcatgcttctaataaagacatacctgagactgggtaatttataaggaaagaggtttaattgactcacagtacagaattgctggggtggccttgagaaacctacaatcatggtggaaggggaggcaaacatgttcttcacatggaggcaacaaagagagtgccaaagaaaagaggggaaaaccccttataaaactgtcagatctcatgaaaactcactcattatgatgaaaacaggatgaggggagtgaccccccatgattcaattttctccacctgctctctcccatgacacatgaggattatgggaactataattcaagatgagatttgggtggggatatagccaaaccatattattccacccctggaccctcccaaatctcatgtgcttgcaatttaaaatgcagtaacgcccttccaacagtcccgcaaagtcttaactcattccaacattaacccggaaagccaagtccaatgtctcatctgagaaaaggcaagtcccttcttcttatgagcctgtaaaatcaaaagcaagttagttacttcacagatacaatgggagtgcagacattgggtaaatacacccattccagatgggggaaattggccaaaacagaggggctacaggccccacgcaagtctgaaattcaatagggtagtcattaaaccttaaagttccaaaattatctcctttgactccatgtctcagatccaggtcaccctgatgcaagaggtgggctcccacagcatttggccgctccatccctgtggcttttcggggtacaggtgctcttccggctgctttcatgggctggcgttgtctgtggctttacaggtgcccagttcaagctgtcagtggatctgccattctgggatctggaggacagtcgtcctcttctcacagctccactagatagtgaagcaatggggactgtgtgtgggggctccagtcccacatttgccttccacactgccgtaggagaggttctccatgaaggctctgtctgtgcagcatacctctgcctggacaccagggcatttctgtaaatcttctgaaatctaggcggaggttcccaaatctcaacttttgacttctgtgcacctgcaggctcaacaccatgtggaagctctcaaggcttggagcttgcagcctctgtacccgtggcctgagctgtaccttggtcccttttagccgtggctggagtggctaggagacagagcgccgagaccctatgctgcacacagtaggggagccttggcccaggcccacaaaaccatttttccttcctgtgcctcttggcctgtgataggaggggctgccacagaggtctctgacatgccctaaggagactttccccattttcttggtaattaacactctgctccttgttacttatgcaaatttctgtaaccagctttaatttctccccagaaaatggggttttcttttctatcatattgtcgggctgcaaattttccaaacttttacgctctgcttcctctttaattatttgacgcttagaattgtcttctaccagatatcctagatcatctctctcaggttaaaatttccacagatatttagggcaggggcaaaatgctgccagtctctttgcttaagtataacaagtgtcacctttgcttccgtttccaacaagttcttagactactgtggcctgggcgtcattgtccatatcactatcagattttggtcaaaaccattcaacaagtctctagaaagttccaaaccttcccacatcttcctgtcttctgagccctccaagtctctaggaagttccaaagtttcccacattttcctgtcttcttctgtgccctccaaaccgttttgacctttgcctgttacccagttcaaaagccgcttccacgttttcgggtctctttacggcagcacccaactttctgtggtaccaatttactatagtagtttgttctcatgctgctaataaagacatacatgagaccgggtaatttataaaggaaagaagtttaattgactcacagttcagcatggctggggaggcctcaggaaacttacaatcatgatggaaggggaagcaaacacgtctttcttcatatagcggcagcaaggagaagtgccaagcaaaagggggaaaagccatttataaaatcatcagatctcgtgagaattcactcactatcaaaagaacagcatggaggtaaccactcccatgattcaattacctccctctgggtcctttcacagcatgtggggattatggggactacaattcaagatgagatttgagtggagagagccccaaaccttgtcagccaccgaggcttatggcatgccttctctgaagcagcagactgagcagtacctgggaccctctgagcctgtggctggagttggagcagtcaggattcagggagtagtgttccgaggtagtgtatggctctgatactctgggcctggcccatgaaaacattttttctcctaggccaaagggtctttgatgggagtggatacctggaagactgctgaaatgcctttgaggccttttccccattgtcttgtctatcagcacctggctatttttgagtcatgcaaatgtattaagtggttgcttcacagcccacttggattcttcccctgaaaattttctaacacctggccaagctgcagattttttaaacttttacactcttcttccttcttaaacagatgttccaactttaacatcaattatttgctcctgcatctgaatgaaggctgcttgttagaagcagccaggccacatcttgtacacgtggctggttagaaatttcttcccacagatactctaaattatgactctgaagttccaccttccacaaatccttagggcataaacagaatgcagccaagttattcactaaggcacaacatgtatgacctttgctccagttcccagtaggtgccttacttccatctgagaccttgtaagcgtgaaatttcactgtccatgtcatatcagcattttggtctcaaccatttaaccagtctctaagaagttctaaacgtttccttatcttcctgttttcttctgagcccttcaaactcttccaaccctttcctgttacccagttccaaaggttcttccacattttcaggtaatttttagcaataccccactcctcagtacaaattttctgtattaggacattctcgtgttgctgtaaagaaatacctcagatggggcaatttataaagaagagaggtgtaattgactcacagttctgcaggttgtataggaggcatggtgctggtatctacttggcttctgaagcctcagggagctcacaatcatggcagaaggcaagggggaagcaggcatgtcacatggtgaaaacaggagcaaaagagggagtgagggaggtgccacacattttaaacaactagattttgtgagaggacagcaccaagctgtgaaagattcttccttatgtcccagaaaccacccaccaggccccatcttcaacactggggatgatatctgagcatgatatttggagaggccatatatccaaactgtgtcactcagtatggcatttcatctggataggatgtacaactaagtagaagcccccttagtttcagatgttgagtatttttttcctaagttacataacatttggtctacattagtccattcatataacataggtatatgccttgatgatataacctattttgtcttctcgtttaaaatcatttaatagaatggatttcaagtcagtaatgtcaacagaattgaattcaaagttataaagagtcctagaaggggtttttttgttaagagaaggattcaaactgtggaaaagagataggatatatgtagaattccacttgcaattaaaatatatgtaccgttattttctcttttcctctactcttgtgattacttctattccttaaatggaaacagctgtcattaaaacgtgaaaatatttctgtttaaaagcaaatatttattgatgctaaaagcatcaaggaaacaaacacactttcaagttaaatttgttattgtcatggtacactgaaatagattttgttatactttatatgcctgaaattagtatgctatgcaaaaggattagagtgaaagatttaagcaggtcagcagtgaagatgctgccagtagctggtgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaaaaaaaaaaaaaatctttaaaatgttgttaaataaattataattaaattgaaaatcaccctaaattgaatatagaataatttgtaataataaataaacatgcattcaacatgttaaatgagaaaaagcagattgcgcacttcaggtataatgattctattttatttcatgtgcttacacacattgggaggctgagatgggaggatcacttgaggccaggagcttgagaccagcctggataacatagtgagatgagggcatctctactacttagggcacactggcatgctcctgtagtcccagatactgtggaagctgaagtgggaggatcacttgagcctgaggctgcactgagctgtgatagcaccactgcactccagcctgggcaacagagtgaggccctctctcaaaaagtaaataaaaaataaataattgtgcttacatatttatcttaccaatgaagattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaaaaaaaaaaaagaaagaaagaatagcaaaagaaacacacttcatttatttgtacccatattagtaatagtaccttatccagaatgaccctagaaaaccatttacttattgttcattggccaagaacataattacatggccacacttagttgcagggaagtataggaaatatttatagtctgtacctagacatattgctgccctatgtacctagacatattgctgccctaagtactattcttggatgaccatttagcggcctctgtcatgacatatttgtattgaatgaatgatgatattaaaaatacacatatgcataaacatattcacacaaactatatatgatatatgctatatagcataattttattatctatgtgcatttttctttacttacaaatgtttaatttggtcatacttgatttagtatatctaatagtcgttataggtcagtcggtcatatgtttctttttatttataatttaaaatatgttttaccttatataattacacttttaaaaatgatatgtttaaaaactaataaatttgaaaatttatacaattcattcacgcttttccataaaacaacacttctggcattaatgagtcactgctttccataaagtatacataacaattatatgtatttattacacattctatattatattatatatacattaattatgatatataattgtatcatgactatgtataacttcatggtattatgtatataacatcgtggtattattttcaagccttttgttaatatcagactgttttacatagcaattaggaagctagaaatgggttcaaatcattccgttggtaataatttgaacttacttttctttcatggcatgaaagtttttgtgtgctactttttactattcctaaaccaagaaacgtgaagatcatgtgaatgtatttgctgttcaattggaggtcagacgttcaactcaagaaaggcttggcgcaagataaatcactctgctgtgaaatgagtccataaacacaatgcacttgccagccctcaaacaaagtagatttacaagtttttaaaaatctcagtgagaagtactgttgtttccttgagtgtaagttactcttattcatgaatatgtttaaattttagaaaactggaccacaaaagtctatcctaactatagtagtctgtgattaaaatggcaaaagcaaagggtgtatgatttttaagctcattttagtgctattttctagtgttttaaatttttttggtttgttcttaaataggttttaattggaagtgttcttttgagaaatggaactaaaactttgagtggggcagtatacttttaaagtcagagtctatccttgggttcataagttcattcaatttggaaattaaaagtagaggaaactgacaagggagttggggcgtgctgtagaattactctcaaagctaaacatggagttaaaactgtgtcaaaaccataattagtatttgcccttgaattgtccttgttaatagaagtggaacagtggaaaatactgcatagaggcattgtctggaaactgcatttcatagccaataaattcaaaccaccttagtggaatataattatgaggaggagctatagtctctgtggctgaagaaaaaacaacaacaagaacaacaacaacaaaaaacgcagagcatgtcttgctctacattctaacttgcatcatggaatccgccggatctatgccattttggatttcattgccaccggttgaaagtggtagatttctttttcttaagtcggctagaagacctaattttagtaagcctaaagggcactgagcaatacaactactttggtggatcgtttccagtttgaggattcctagtgcacaatcagtgaatgttgtatggaacgcatggtgaagaaatacggtttagtgaatctggaaacttaaaaaaattggccttggcatcgtgaggaattcccatttggccttcagcatttttgtctatgttggcttttctgtcccaagactttctataatccaatttatcacttgctttttgggttaaagggaaataaaatttccacacttcttcaatacatgtgctggagaggacaaggggagggaatttattttgtgtgtgtgttgtaaaatcagaagcaattgttgaaaggtgatgaacagtttgaaaggtatgttgttctcttgtactacatccagtggttactatgaagtttttctcatcactcttttgtatcctttcttaaattctgctgtgtggcagagtatcttatttatctccatattaacatgccttttgcaaggtttagttatattattgcaactgttctcaaaagatacaagcttcctcctaaaacacgtcacaatcaggttttgctagacagctactaacagccttaaattaaacaggatctcaggatgtcttgtcagtttgggttttcagctgcagacagttgacaagggataaagaggacagaactaatgccacatgccatctccctccaaagagagaatccttgacccctgagtttaccattctcatttttgagattccattttcacttctaccacatacaaattgctttccttgtttttaacacagtgaagtaatttgaaaaaaaaatctgataatgtatctcatatctctatgtcttttaataggaagagggcacatattaattcaacgtattcatttgcaagaacacaaaatcctggacttttttttttaacttactgatcattatatatctgagaaatttggtgtaacaccaagtcttttgtcatcagtagctcccattttttaaagacttctatctctatattcaataaatgtcacaattatttgctatcattattttaatatgtttactattatttttattttaaaatatgttctcattttcatatacttactattttatttttagtttaaaaatattttttcagaaacctaaaatgtcagtgaatacaggtaaatatttattcattttgactacatagaaatctaaagcaaatattgattgtgatatgtacatctacatattaatataacatttttataaacgtattgtttctgtttcaaacatgagtcttggtcaataattgatataaataaaaattcaagttttccacaaaattttgcttatgtaaaattaaataaggtaacctttatattcagtcagttctggctcctggataaattgcatgcttagaaatttcactttaataaaataaaagttttctcctcatctgtaatgtattctcccttttactgtactggcatctacatattgactgttttcatgaattatttcttcccaagatccctacaaagaagtaaaactcattcataatagattgtatattaatccccaaattccatgtaattctacagaaggaaaaaaacataaaccaaaatcatggtacttgcagtggaagaagcataagcatcctacatttatacccttttccccataaatacatagtgtgactggcagcctgcacagtaatgattaaatgagacaataaaatcttagcaattcttaccctgagtctggaagtgattaccgtgtccaagagcaagtcatttcctttttctaggtgtagtttttttattctacaaaatactaggaagagattatctccaacagaagtcacatcttctgggtcaaattaggatcacaaacatgtgtttgtgtattaaaatgttttaaatttgaatcagctgacaatacttcaaaaattgggagatttgatattaatatcttgtaacacataatgggtaaaagactgcccctggcaaaagcctgcatctctggttctccagaagccccacccttcccccttgctaccagtcacttaaaccaagtctgtgttgtggcttaatgtctaattgcctttttatttaaaattctgactttggcccctggcctagaatgaccattaatggtatatttagccatgatatctatgattctttaaccaataactgcttaaggctatccttgccttgatgtttctcccagagcttgcctagtcaagcttcatcctcttagttaattatggtcctctatagaatatgtgctattctgtcttttaaaggcttttccagggatacatttgacatatttaaacatgatagctaggtaagctgtttcaaaggcattatcctccataaacattctactcttgtataaaaagtcatttcaaaatatactattttactagatttattcatgattaagtcaagagttgctccatcggattagtatttattttcaattgccttccttatatacatgttagatagcgttgcactctgaaactggatttgaaactttatttttttctttataaaatattagtgcaaaaatcacaaagggattcaaaacacacacacacacacacatactcattattcaatagattttgtatgtttgaattcaagaaatgatgagttataagttatatctgaaatgtccaggagagtgggtcttaattcagaaagaaaaaaatggaaggtagttaaaaatgatttccatagtaaatactcaatagaattattcactaagaagaaggaaattatgttgaaaacttaaacttttgaggcttttcaagagtgttaacaggtatctgtgacatattttttagtactttaatttggtggacatattcttataatctgagttacaaatcaatttattaaaacttcaattagtttttgtgaaaataatgctgtacaataaatgatgcaaaatgtcaattgactaaccaccgacaaaatttatccctcactgaaattcctgtatgttgttaatgtgtccctgctttgggctgtaggttgggttcaggtatctatgtgtcttttaatctggagcctatcctttgctggggaataatatttgtacaggatagggcaggatcgcataaacaagtcaaaccacacatgtgcatctacatcctggttggatacagcttattatattaactcacattcgattagttgaagcaagtcacaaggtcaagctcaaagtcagtgaagaggagcattatagaggcattgtggctaaaccacaataagccatttcaatgtggggaaggaaggaagaattgtgaacacataatactatctgtcacatgaaatatgcttggtaatttgcattattttggatatttcacataacaaattcaaaatatagcttgagaaagataatagacaaagatgtcacatattttggaatgatgtttaagaaagatgatgctgtttcagttctgtaagctcttaatatttatcaatatgtcatctttgttttaaaatgtaaagctttatctacatgatgattgtgaaaagtgggtaccaagttttgggctatgtaatagtacatgaaaggaaatagtcataagaaaatcatgaatttagaaaaacaccattgcattgatagattttattaggggtgtcaaatgtttcagcttataggttagagaaatataagcccctcttttcatactgctatgtggtatgacttgctgttattataaacttctgtacattgcacttgagtttgatgaagatccataaagatttagtcattgaaacataacagccattgtgccacataaccttgggttgaggtctcaattcagagccaacttcagacagcaccatgaataaaatttgatcttgccaatttcacattccccatttctcccattcaatatgtacacatcgatgttcccaatgtctttattttgtcctttggctttggattccatatatatatatatatatatatatgcacacatacatatatatatgattctcctttaatttcactcagtatcctgtcttacccattttgaacatctgtttaataaacagttattattaggcactctgaatttaaataatcaggagacatggttccctaggatggtggtattcaaatgattttacaaaaatcctggcagattataagaaatagattttaattgcagtccactaaatacatacatatacatgcatacatgaagcaaaaatttcacaaataataataaccttactacaggtatacattatgatttattttatttcattgggggtgagtgttggtagccactcactaaatgaatgtcagtccctagtgtttctgaattcagtgtataatagcactttaagattttaggtttaatggtggccagggataagggtcagggaaaggggcagctacacatatctccagtattattaaatgccaaataaatagtgcagataataagtgctgaagtgtttagaaaaaggggccaggcgcggtggctcacgcctgtagtcccagctactggggaggctgaggcaggagaattgcttgaacccgggaggttgagactgcagtgagctcagatcatgccactgcaatccagcctgagcgatggagcgagactctatttcaaaaaaaaaaaaaaaaaatttagaaaatgaagaagcttattttggctaaaatgtaatactagaagttatcaaagatgaagaagaagaggtaggacttgaatttcatattagtgtttcaaaatatattaacatgaggaggtaatttaattattatttaggaatggttatcagcaagacatattttagaagctctgtaatagtttcgagggattaagtataggagttcattttgggaattactgtgagataaacatgaaacgaaggattgattatgtattatatctgaacatgaattccaggccaattatctcaacatttatctttcatgcaatggagattttctttgagtttctgatatggaagctagaatgatgtaaaaaatatttaggaaggggaattcgatatgcaccatggtcacctacgtgctattgtattttttatgtttttcttagatttttcaataaaaattctaccatgtgttttctggggcttgttagcaatttagtaggagttatattgaatagtactttaactcaagtgaaggataactaggtacactcttgagacaggtgttcattggcatatgatgtattcatttcacacattataggttctagccttagaatttttcatgttttaaaagcattattccaagcatccaatgtatgttgcgtttatcccatatgattttgtccagaatggttactgtccacagaggttttatctttgtctgtggtattaagctttttgaggacaatgcaaatggcttcatattcgagaatgataataatttggtcaacttttatgtactgagaaattaattgaagatttcaaaagactaaatagcatgaaatatttataattgctgtatagtgaaaaataatgagagattttcctatccttatacggtattttgcagagggtataagcaaaagctcttgtgatttttattcattttgggggggagaattggataaattatgttatgtgtttaaggtactggtttttgttttattgtaagcaaacttatttactttttatagtgctagtcgttatcaatgccagaggactgctgaattgtcctgttcccacctccagtcctataggacttcaccatctaaaaacaccttagttcccatacagctttgctctagagtctagaaagatgctaatgattatatgctagaaggaatcaagtaatatttggaggaattgttcttgtgtcttctagattatcattttagaagcaaatcatgctttctgtgagatgtccataagtgcctctatcagagacggattataatgctgtggtgttatgggtctgattctgtggggagaatttagcttactaatttcgaacatatatgcaatatgtatcaaatagtaagtgctgcaaagtatgtccctgtgctttaaaagggaattactgaagaaatttctaatttcacaataaaaaatattttagagtagcagggacttgtttttaggaaggaaatctgccatatattagcaagcaccattacattttaaagtgatatttttcaggcatgtaaagagtcaagttcttgaaaataagaacacctttattatcatgtaactgcatttcagcactgcatcgctctctgtattcccctctcctctccttgcctacctctctcacctttatttcactctcttccttctaatcttgtcactttgcttttcctgcactttccttcctcgaggcatttgtttatgcagtttctgtagccccacatgcttattcttctcctataggtaaacacaattccaatttttcaaaatccatctcaaatcacagagccttcacgatggctcccaaagcttccatcagatttaatttgatgtccccatatttgccatagattgtgcttttaaaaattgtagttatccttctctgtcttatttaatggtaatttatgtgtgtccactcatttcataatgctctactgtaggttaaggcctatgtctggctcacaaacatcttactcattgacacagagatttgcatagagcagacaccaaatagatagttacactgaatattttatgaatcatattaaaatctataggtggcttttaaccatactttattgatgttgtttaattagaagtctctctcaaaaacttcatatgctttgatgctggggaggatgcctcactcattgttgtatccgtatttgtaactaacatttattgagttccagttatgtgacagactcctactagctctttgcactttatatggctcatctcattgagttcttagaataacccaccagaataggtgggcagtaatagctgcagtttataggggaaaaaaaattatgagtcagaggctaatttactttccaaggtttgaagaggcagtaagtgacaaaaccaagataaaaactcagaaagcttcattactttctgcaaaccttgaacaatctagtgaatgaacgaatgtgtcttcagagttatgacataaccagcaggagaaagaaaccatcatgcgacttcctaaaatacgatgcattatttctttcaacaaattatttaagtaagtgtactatgcttagtagttatgtgaatcattatcttggattttattaactgtagggctgtagactttggaaagaaagatcctaatactgtgttcaggaatcaatgagaaacaaagatattagtagaaaaatggagtggaagagaggcagtgggtgtatcgattatgtactttggtgattatgatttctatgctatggatatttaaaattttattttcctcttaatcttcaatttccatcttctggtaacttctttagatataagaccaagacactttctttaccgttatatctgctagatttttatccagtgtattttaagaagtcttttttatccagtgccttttaagaagctcagtccgggtgcagtggctcacgcctgtaatcccagcactttaggaggccgaggcggcggatcatgaggtcaggagttcaagaccagcttggccaacatagtgaatacctgtctctactaaaaatacaaaaattagctgggcgtggtggcacgcacctgtagtcccacctactcaggaggctgagacgggagaatcacttgaacccgggaggcagagtttgcagtgagcggagaccacgccattgcactccagcctaggtgacagagtgagactccgtctcaaagaaaaaaagaaaagaaacagaagctcaataagtgttatttgggataaagcattaactggtttaaagctcaagattttaaacaactcaggattgggcattaaagaataacagaagctaccatctattgaatttttattaagacatttcaggacaccaggagtaagaatacagggtagctgtatttgttatctattgctccataacaaataattccagactttctggcttaaaactactcattatctcacagttcctttgactaggaattcagcatctctaatttaaggtctctaaaatgaggttccagttaagcgattgacagggtctgtcgtcttatctcctgataagactaggaggcttgactagtggaggatctgcttccaagcttacttgtggggtctcagttttctgctgtctgtgggccagagctctctttcagttgcttgctatgcaggtggcctcatgggactttctcatgacatggcaactggtttctccatggtgaacagtctaagaatctgtcaagatagaagccacagtgtttttataatctaaattggaagggacattccatcacttctgccactttctattggtttgtagtaagtcagaaagtctagcccacattcaaggaaagaggattatggaagggcataaataccagaaagagaattttgggtgactcccttagaagctgcctatcaaagtacttaccctgccattctgtctacttatcattgtatttctctttaatttgatcttgaggttgtaaagtggctataaactttagccctgccctgatggagttccaggggatttatttggctgtgggtatttatgatgtgcctttcactggatacttctttatcctagtggataacctaattcctgtgcctaacttgttactaggtatacttcacacacacacacacacacacacacacacacacacacacacacacacagacacacacacaaacacttatttatgctggcagactgacagtcacctttgcagctcttgtctgttctgccaagatagtcactctctgggaaagctttgaccagaagaaaaattgggtatggatgtattggtcaggagacgtagagaaggcagcacagcaaaacatatgaagtataagaagcagtttattactcatgagtccacgagagaagacggctactatataggaagcagggggcaaggttgcaggggcaatgtgctgaaccatcagatcaggagcagatagaaagaggacctgtggggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagacaagatttgggactacaaaacattctcgaggtagtgttccaggaagctactgactgtcaattatttaggattggaactccatttgaaatctatttgttctttatattgtttttttttaagtttatcttcattaaaaagctgcaaattaggtattcatttttttattccactttggagaaaacaacaacactaagaaatgtcaaaattaatcattgatatatttgtgaccagtaccttcaaaactagttcaacctactgaaaactactcaagctctttccaccacataatagcactttcagatattgtttttgcagcttaaagggaatttgcatttaggtatgtgtacaatatcaacaaattggtgctacaggcacattcaatgttcttctttttagaggaaattaaattcaatttgattaggttgatgtggacaacattaaaataaatgttaaccttattctgtatttatgaatcaatactgatagttttaagatacctggccattctacttgttggtaaggtcttggaataaggaaatcttgacagaagttttgaagagtatattctttatcatttcaaactgtgaaaactatgcactttcctaagagtagattttaaagtcacacaagggatcatgctgaaaactgacttctagagtctttgctcagcaggttgttgcattttttttctttactattgaacactcttttgttcatgccttttttcttattgcttgcagaaatgtgacaagcttcaaacttacacagaaagaataagtagtagagatactaggtatcattgcacagcccagatgtcttttgaaaatatttattcagctgaactagaatttcaaaatctattagaaaggtaaaatatatcttggaaaacaaaagcagattttgaataaaacataggtaaaaaaacttttaagtaagaaaatatgaaaaaatggcaacagctttaaatgataacttgatggcttccacagaataattcatagtgtaggtattttttattaaaacttgacaaatattctaaaaaatgtaaaagtgaaaattaggtattttaactgagaaagatgaaattggcaccatctaaaaaaattttcatgagttccatttgtgttaagaaaatatttcttatttaatcaaatacatgtgcaaaatgttatcttaaaatccttttagagttttgataaagaatgctcaatatgagcatacatattcagccattagttatattcacattctcttccagaaataatctgttaataattaaatgtgttttataaacacttacataatgaaactcaaattagcttctcagataaattgttgttgctgttgttcagctggtattgttataaaccatcattcatataactttattatattgtgagtgttttctttgaaactgatcaacctcagcatttaggatatgtggactattagatggagaaatgaatatttgccttagcatagtaataaatattgttagactgacacaaatattagcctgcactcatagtgcctaaaataggccattccagtaattgcttagaaaaatattatttgtacagcttgtagaaatttacaaatgaacagaaaaactctgcatttgacctaggatatatgaattcttcaaataataaatatatcaaatatattctgagtttgaaatagtctttaccttgagccaccaaaaaggaaaagaaaatagaatcaagattacttgttaattttcaattttggggtgaaaaaccttattaaacttctccagtaactaaatcacataaagttcttcagtacaagttagattgtggaaatagttcatgtagttattccacgtctccttctaacaaaatatcaacagttcaaatatccagtttccttttcatttatgcaccattgtagttgctaatataaatgttggatctttctgcctcccactcacacctccagcccctcccctgcccacgcacctgcactggctcacattggtgctctttttctgcgggctgcgctgagcagaaaaggtgaggctattcagggttctgtaatgctcaattccatgttccgtttcttttcctcagaaacagttgaaacctatctatggatgaaaaacgcttcataatccaaacattacttcaatcagatgtgaagagtgggtttgctgcactgtaacatgctattattgcttaggtttatttgacaaaagtgaacaaccacaactttcaggaaaaactttttttttttgaattttatgtgagttgtccttttggaaatagatagatgagagagagacagagggacaaataatctgtatgaattttggcttttctcttgagtataaatgtttatctttcccccttcaatgtaacttgcttggatgttcaagtgtggagtacatttcttttctaaaagacaacatatttttcaattttattcattgatttatcactcaaaacatgcacttgaaggtactcttagtactctccttcatggccagtttatctataccgttttttcagagtttcttgagacagcttgcttttttttgtttgtttgtgttttttgttttgaccgagtctccctctgtggcccaggctggagtgcagtgatcttggctcactgcaaactccgcctcccgggttcacactattctcctgcctcagcctcccgagtagctgggactacaggcgcccgccaccatgcctggctaattttttgtatttttagtagagatgggttttcaccgtgttagccaggatggtctcgatctcctgacctcgtgatccgcccgcctcggcctcccaaagtgctgggatgacaggcgtgagccaccgcgcccggcctgaggccgcttgcttttaaagagctctcgcaaacaggtagcataggtgactgccttttgacctaaaatgtgatattttagaatatgttactagaaatttgcaataatgttcttaaaattattaatcttattgatgtgtttctggagcccagtaccaaacactgatcctaaagattgaatttggaacgaggccaatttagtgtttccctaaactgttttgggtagaacgctaataataatgccatgtgcttttactagtatttcatagccaaatacatttggggattacagagttagcccactcgtagccgtcttgtggactgcacggagcctttactgtgcttgcatgcatcatgcacccacctctccgagagtggtgtcatatatgtccattgattggaatgagcaggttactcctgcttccctctgtagagcgcatcatgcagaattgtttgtgtgtgtgtgtgtctgtgtgtgtgtgtgtgtctataccactttggatatcactcagttaacagttattgtctaaatcattcttgtgataagaatgataatcttattatataaatgatagaactatacttgagaatacagcctgattgttttatctatccattttatcattaaaagtgaattgaaaactttactattatgaaccctgtcgtttcctattgaggttctttaacactagaacctgcagaattagccatactttgacattaaaactattacattgccatcctctctttttccctggtgaatatttaggtgcactttgagatctggtattgctctagtggtgtgcctatttttttttaatattttcatttttgtttaatctacagagaagttccgagatcctccagagctctgatgggaagaattgtatagcgtgtcccctgccaaaagttctaataaaaaatttacacagcggaggctttgattaaatgaattattcattgacaactatccatcagggaattagaagtttatggcaacatgagctgtggaaaatagaaagaaaaattacccattactaactttttaaatgagaaagtcagaaactcagattgaatgtgaatttaaccctgcacatggaaagacactatgcaaaatattgagaggagttacataacctttatgcaatttattacttaataagcacataattggctgctaattaacagttgtagcatctttctttcttgtctttcctctcgttaagcgtaatattatgtgtagaactagcatagtgtggtttctgactttaacattcttctgtaagatcacttgtgttcagcacctcgcacagggttctattcacagaatagaatcctattttgttttcttttatattagaaatagtccatggcatcttgacaaggtgttatgaaccagagaggaaaggtcaatgatttaaaccagctttaggagaagcatatatagaagttgtttctcggctttctggaatgaattttaacagccacctataattgaaagcatttcatgcagggcatttcacaaaatggacattcaaaaactacaggttgacctgtactgaagacgtgaaattgctttgtgcctttgagaagtactcttggataaaccatgccattgtctatattgagttccctgattaaataatagtctctctctatctctttatctctctctagctagccatccatctatatatataacacatgcacatactcaaataaatatttacataacgaatctatcgatgtatattagtaagtactatgcattcagcacatgattagggtgcataatctcatatgcacgttgcaaaaatctttgaggggtagtatcattagtaatatttcatatatgacaaaactgaggtttaaagagtttaagggacttttccaagttcacatactaagagaaacagttactatataagtcacgttagccgcaaaggcaagcctttcttctttttttggatattatataaaaattatatagaaaagtttctttttaaacctaagccatgggaacaattcttcagttttcattttattctagtaaatttcttttcttttcttttttttttttttttgagacggagtctcgctctgtcgcccaggctggggcgcagtggcctgatctcggctcactgcaagctctgcctcccgggttcacaccattctcctgcctcagcctcccgagtagctgggactacaggcacctgccaccacgcccggctaatttttttgtattttttggtggagacggggtttcaccgtgttagccaggatggtctctatctcctgacctcgtgatccgcccgcctcggcctcccaaagtgctgggattacgggcgtgagccaccgcgcccggcctattctagcatatttcaactcttggtggcagaaacatctttcttaaatttcacccagaagtgaattacatgcccaccctttctttttccggatggatatgtggagagaacaattatagttctactttgctcttggctgtaggtatagttgttaataattagaaaacactcgaatggcaggttgccaattagagaggggagtataaagatacacagaacccgggcaattcaaatttgggacaatcgcctttaaagacattgagagttcactaaggttgctgatgaatcctgtcacttgtatcagtcaaaaggataatttgtaaatagcctgtagagaatcaaaggccagaatatactctcttttctgacaagcagaaaacacattatatgggctaattttccctgcatttttatcttaaaaaaaggagatgggtttctaattctgcaagcaaatatatattttttctaaatgtgagctatttcgaaaaacctaaaaccactcatcctagagcaagaacagggctaggttgagtgtccaagagaagactgtcacaggacctggcacattagtgagaaaggtgacattactccaggggaacttaatgatgccatttatttcttgatgctctgaggtacagcccccatttagacagattactctgagaattttgtaagatatccaatgagatacaatcatctttattggtggcactgtaaaggcaagtatgagagattttggcaagatcatctttttttagagacacatttatcatattcctttttaccttctttattaagtaggtactaatactatttctgattcactgctctctactccaaggattgcactaataggaaaattttcataaagcttttggctaagaactcctgctattgacctatgcccctttgtgtctaggttgatccagaagatacttcagcataaaaataaattccaacaaaatttagtttcaaattataaaagttgatatttctgctttatttgtccaaaagaggttctaaaatgaaattttctcaatttcaggtccattaaaaagtctgaatcttataaatatgcatagcttttataatacttataacttagatattaagaaaaatcaagatgtacattattaaagaaataacatttccattgttttcctttctcagaagtgggataaacaagcactgtaaactgaaataagcaatgcattctcagttccctcccaaaagaaaatactggtgtgcctgacttaccatttcagaaagtccagaaaacgctgcaaactaggcaggcagtcaagtgcaatggcaatgaataaccttataaaatttccagactttaagactgtcagtctggaagactacactatcttttagcacaaggtacttttggagattactctagggatcttagagaataattatacttaagtcctgccagggcctttttttttttttttttttttttttttttttactgtagtcaatagtacttccattgtactccttacatgacattatgttacagaagaaaatgttttataacaatgtcatttgagtgcttcagttgttacctctccttgaatacatatgaaagaataattacctttgtagtaaaggacattctagttatacatctatactttattggtttcttcatgtttttctcttcagaagtagaaacttaatgaaaatattgcgtaagtagagagcagtttatgacagtatttctttctaaataaattaaagattttattatatcttgaaatatatcacatatgtaaaatattaagtataatgtttgtgatcattttgaaacacagacttttaaactttaataaattatatccaagtaacattttaaatttgttatctaacttctactgttaacatctgaaaaaaattagaattggcagacatgcaagatgatgttgactttgcagccagaaaatgtggaaaggcctcaattagtatccctgattcacacttacaaatgggtgtttcagtgctgtgcagtttgataaggtagttaaggccatagtttgggagacagataggcatggattccagtcctggctcaggcatttctacttacgctattcgggcatgtcagtttttctttctaaggctcatttccctgtgtgtccatgaggaaataatgtgtttccttggtagaaagatggttgtgagggttcagtgcaatcatgcatatgcatagtaagtattccatatatctcaatatcatgatttatttcttgctacacaaacttacagtctactcactacctttgatgtaaagctgtcccactgtccttctgtgctttttctagaggttgagctcttccttcatttctggaatagttactgatttcaccagtaatttgccttttagatccgttgttacaggtgcctttttgaatctgactgctcaaaagctttgtccattttgtgttgctataaaggcatacatgaggctgagtaatttatgaagaaaggttttggtgctcatggtcctgcagactgtacaagaagcacggtgccaacatctgcttggcttctggtgagggcctcaggctgcttctacttatggtggaaggcaaaggggagctgactatgcagagatcacatggggagagaggaaacacatgggggcaggtgggtgatatgccaggctatttttaacaaacacttccctgggaactagtagggtgagaattcagttgccccaagggaggacattaagctattcataaggaatccgtccccatgaccaaaacacctcccactaggccccacctccaatattggggtcaaatttcaacttgaagttggaggagacaaacatccaaactatagcagaagcctttttttgttttttaaagctttagctttacctgccatatataatagttcaagcataaaattcaatgtcttttagcttttttagagttgtgctgccatcaccataatgaaactatgagacctttcaaagagaagacaggtgtaaacttgtgttatctttgattaggttatgatttattagatttgacaccaaaagcgcaagcaatgaaagagaaaaattcaagttagacttcaccaaaattaacagctgatatgcctttaggaagcatgtaaactcagaagccattcttacatgactggctcatggacatcattgatttgaccagaaatggacattaaaaccatgggaggctgatgcagtctctcatgtatgaatttgaaatagacacaagggaacaccatgaagagaatctctgtggaccttaacattttcaaattttagaaaacaacattttactatgtggaatggacagggagagtgtcaatgagaaaaacaggaggaggaggaaatgaagagagtttggcttaaaatgttaccactcaaaatgcctagcatgaattggggcaggtccatgaactgcttgttattggtctctacccaataagaagctggctccagaatgcagttcagttgacattttcttttgtaagaaagattttctcaattaaaaaaaatcaccgtgttgatttgcgtttgatagaatcttgtcatcagacaccagaattttgggtagcatttttcttttttttcttttatcttttttctttctttctttctttttttcttcttctttttttttttttttttttttttttttggagacaggatttctgtcgcccaggctggagtgcagtggtgcaatcttggctcactgcaacttctgcctccttgctttaagcgattcttatgtctcagcctcccaagtagctggaattatagatgcagggcaccacgcccagctaatttttctatttttagtagcgacagggtttcaccatgttgaccaggctggtcttgaactcctgatctcaggtgatccacccactttggcctcccaaattgggtagcatttttctagaatattgacactttaagctttcttatgatactcacttttttctttcctacactgttatgcccagtgggagaaggttgcttctcttaatagttctcagtaaatgctgattaaataaactgtagaagggtaaatagttaacaagattctgaatttggacttgtgatttttgaggcaaaaataataggttgaaagacatgttttttggatcaacaggcttgtatggaggtagacatttataatcttagtcatactagtgagtgatggacattttattactgttttgcaaaggtatggacaaagtcttaagatctatgtcttctacttttaggcatgtaggtaaaaatgtcagtaacaatgcagaaagccagtttatctatttaaaaaatgaatatattggaagccttgaatatgaggctgagtaatgcaagcttttcccaggagaactgtgacttcttgaggcccaaagctgcactccggaattataagtcctgagacatagtctataaacaataagtaaatatcagtcctatagctcagtgttcaccactgatgacttctcacacataagcaatatcatgttaagcagatagatactcatagtcatccaatagtttgcagtgggaaaatagtttgctaaaaagcaagatgtcatatgtgttgttatatttttcacacatgttgagaaattatctctgttgaagatttcttgagttaaccttggggcattagcctttgctgcaaggtttgaaaaactcaatttttcccattcagtgtgatctattacaagctattctgcttcctgaatttttgagagtattgctagttattttattctcagttacctaagaagggtcatatgagggaatgttttgattatcctaaattcgtttctatggataacttcatatctttgttcagatctgatttcttccatagtcacttaaacttgagaattctatcctatcttccacaaaagctatcattgaaatagctgtgctttccacttaaaaagtgaaaaggttaatggtatggagatgaaactggaatccaatcctcataaacagtactgtcttttccatttttatgttgcctttttggtcacctagaccatacacaagagattttatttttctttttgtctgattgcttctaaacagatttctattacatctccaaatttcagtttctctcccactgttcactctaggataaagtggagttcttactttatttcaatagaagctagaaataggtaccttaatgaggcaactcttgattttatttcagaacttggtaaaacttcggcttttcatttcaaaaacaaaagtaagcctctgtgcttgctgatctgtgttccgaagacttattctccctgtgcacccactatttctactagctagaagtaaggcagaattcccgtagagtaattgtgtttcagttgtatttcagacaccacagacatgaaagcttcacagaaaaggttgcttcttcctcagtggagctcatttggtaatagatgccaggtgcatgactgatgctggtttgaaatggaggacccagtaatggctatatcgcttggtgaaatcgcatgagctcaccagaattagaatatgcccgtaggagtaaacataacttctcatttttgaaaaattcgtaacttctcacaacttttgttgttctcattgctattgatattgttttaataatattcatctctatcagtgcccagcaagaaaatatatgcaacaaatattagttgaatgaatgttttaatccacacagtaagagccataggatataaatatacatgatcaatattccactgcagaaaccactggatatcttaaaacattataaagttacgtgcagaaaactattgctgtgctttatgattttaaaagtaaggtgtatttataataaaatatttaaaaatactgagaaattttagaaattttaaaatagtgacccaagaataatctttagttttagtattaatttttacatatgtacttaaaaattactgttgttgttattattattacatttgtaaaatgcaattggagtatattcattactttaaggtaggagtggggaagtggtttacttgagaaaaatgacatctagttttgtactttttctcacgctaagaagtacgtagaaacaagcaatcaactgaataactttagtgtttatttttaaaagtgatatatatcccaacaacttgtaacttattctttaaataacagaatttaagaaaatgaacaatattagataatattacataatagttatgtctcacttttagtatttttgtctttctacatgtatgaattttataattaactattacaatttttagacttccaaactaattttcatgattttggttatctgtattggggtacaatttacatacaataaaattcaccaattttacatataaaatttgattagttttggaaaatgtgtggtatttgcccctggttttctgaaaatagaattaaaaacccatcaaatcttttatcccccttcatctcacttccagtagagatatacttcttacattttatacttataatgtcttacctatagaaactgatagaatagggcctttcacaatactaattatttcatttggtgtttacagccaagcagttttgctcctcagaggatcttaactgggaactaaccctcatctgtaactatagtttctcacaccatcaaactttacttaaaatgtgccagagcctagttaaatgtcaaagaagaggcctggtagcctttgtttggaaatagaagacagtatctactttgaagttattgtttctaaccaatagcatcctcggattttaacatttttgttttattttgtttcagtctcactgacaaaatacctttcccattttgtgccttaatttccggtttgaatagcaatatcttagctcaatctttaaaaataagcactgtttttgtcccttttactgactgtttgctttttttaaaaaaagtccaaattagtttcaagatcaaacttctatgtatatttagaatctagccttgaatatttcctaatttatactgaattccatttatgtatcattcttggattagattttctaatctggccatgtttttttctttcagacctgttactagctcactcttttctattcaaatcttatttctcatcctggcctatttcccaagtgcaaagacagcggggcttcctgtgtcttagggctgcccagagctgatgcatatcactcaattacggtattataaataatatttttagaagtatataataaaaatattaccaccttaacagcttaaacctgaatttgtaatcaggttagaattaatccatgaaaaactttgtgatatagagcattgtgtttttctatgcacaactttgttgaaattctagcacttgggaaatgatgtctactcaagatttacattggctaattcttctcatactaattatttttactatgttgattatttattgttttatattggttgatggtttttcttgaatgctcaaataagcagccattcttgataactattgcttatctcagatgtgaagtatataataacattttattactggttttggttattggagtttattttaactaggattttactcttagttcagtttttaattcagtctgaaaggtattattaccaggtaggggagaggtcaaataacgaacattattttccaatcattctggcaatctttaaaaatgtggttccctgagtatgtatgtagtcatgtaccacgtaacagtgtttcggtcagtgatggactacatatatgacagtggttcaatgagattttattaccatacttttactgtacctttttacatttaggtacaaaagtacttaccaagtgttacaactgcctgtagtatttagtacagtaacattcacagatttgtggtctaggagcaataggctagactgtatggctcaggtgtgtaatatgctataccatctagatttgtgtaagtgtactctatgatgtttgcacaatgacaacatagcctaacgatggacttctcagagtgtatcccggtccttcagcaatatataactatacatatgatactgggttgtgatcatttcccagttacaaacaaattagctatcaattttctccataatatcaaactcttatgtgattctaagtaagtaattggcagaaaggagaattcacattagtttactgaaaaaaacacagtgtagttttatgaaatcttgcctgttagtgatataccctattcgcttttgttgacaaaatgcaaattacttctttaatattactcttctccataacattctgatttgtttaaccttgtcatgtttctgttaaaccagttcaacagaaagggctcatccacttataaataatgcattatctttcaaaagccctagtaattttttgcttataatctctgggtagcttcagtaagtcaaaacatgacttcatattctaacttgtcaaacttttaagcatcaagcaatttttcctgcacttttaattaactgcacaaaatattatctgtaatgaatagatatgttaacaagttatgttagaacaggacaagactagcttttggctcagtggggtagaaaaaagtaaatatattcttattgctgttgttaggaggtagctatgttagaatgttgctatggaagagagatgctactgaattgggtgcagtgaggggaaaacatgggagttaaaacatgtgggttatacacctatgtatctaggataccatgcagaagaggttggaattagactgatggttaatcaatgggataaagggatgtgttttcagtccttgtcagatgaatttctactttatcctctggattattggcccttattcttctttcccttagaacttatcattcttcaaaattacaattatttctgtaatcatatcaaattatcagcttcttaatgatgtttcttacccactgtgttttagcatctaagatatggatgtgtagctaattgtcataatagctaactagcattcattgcacgttcatataatgtccagctctttgttaagggctgaaagctcattatctattttaggccccacaacactctgaagttggtattcttaggaattctgtgaatgagaaagctaagacttcaggaatttagtgataaatttaggtaaaagttagagcaggcccaggacctacgtctctctacagtgacatacatgccctgaactgctactccctctctttctcacattacctaggcagcttttattgtgctttgttatctttaaaatagcgaattaacacttgctatttcataagcttaaagatgcattgcctgtaatattggaagctgatatgcagctcaccacatatccaaaggccggtaataatgaacgtaaaatagggaagaaaagacagagtatactgggatggatcattatctctacatgttgatttattttaaaagttcctttcagtgtatattaacaccttggaatgtgtgcaagttacaccggtgacctttctgcatagaactccaatgagagaaaaggcaacccattgttagatgaaatgcttttcatttcaagcatgtaagcagtaccacacttggtggattaaagatcgattgatctcagcaagcaaagaacgttgttaaattgttcagtcctcctttctggctttctctttttgctaagaatggaaaaagagaaggccttggtctctgttgtctcagattcttgtacctagggctataattgctgcagataaaacccaagaacaattgggttgtggttttcaagtttaattacattagagctgcttcttttgccctatagtcacatttgcaatttgtgattaacatattagtgggaagaaagtaatgatagattgtagttaatgaagcattttctctatctgttgtttcttcaatgcctctttcccgctacaggataagatatttatgttaatttttatgcatgctgtagttaggtttctatatattatgtagggaaagttctgcattagctctaataaataaagtgttcagttttaaatcatggtctttgctctactttatttatttgtatttactctttttcattactgcaggaggaaacagactcagtgttttatttttataataaaatactcttactctaagaaagagttattatgcatcctaatactggtatgcaaacatcattaaagtttacacagcaatggtttttaataacatttggagatattttggctgatgcagtttttgtgctaatattttggcttcaagataagaaaaactggatttaatccttgctagaatgctgggaaaaactgatgttatttgtaaatgaagatttaaaagcatttaactaagcttcgttttaagatatacatgtagagccacatctttttttttactttggaattttaaaatatgatttatcttcctttgtcaggtagactccagagtttaaagtgaaatatatatatgtaatatatatataatatatatatattacatatataatatatatatataatatatatatatataaaatatatacagaaggctgagaatcaaaccagtattgaagcattcttaccaatggcaactgggatagtgtttgagaatgagattgtggggtgtgtgtcgaggaaggaggtaagggtgtggattaaaagttttggaggtgagatgatagacaaggaagaaaattttattgttatatctttccttattgaaattgctcattagtttgaatccttccactgttgtctggactccccattaaaaaagaacatgatcactgagaaagtgtctaatttagatgtgcttttgatagcaaaataattataatagacaaatccttgaaaaggaatttccttgtcacatgacactgatatactacaaaacagttgtgccatggcagcttataatatttaagtttcctgattctaggtacaaagatctctctgtgaaagctggccaaatattcaagaatgtactgaaatattcaaaaggtgtacatttatgatctagaataattgataagagttgaataattggattgcttcactagggaaaggcagaaaatgtatgactgtagagttaacattcttgagattattaaggaaatgataaagataacaatggagaattcctttcagtgtactaaaagttagggaagcagtggaggcttttgctgaaatttgaaagagacaaatattgaggcaagtgaaaagtaatagtcgagtcatttgagatatgtgcattttactctgtcagttttattttatttttaattaattttttaaaatttcagtagcttgaggggtacaagtcgtgctgggttatgtggatgatcgtacagtggtcaagttttggcttttagtgtgcccaacaccaaaatagtgaacattgtattcaataggtaatttttcatccctcacctccctcctgaacttctttcctctgagtctctaatgttcattatactactatgtctgcctttgtgtacccatagcttagctcccatttataagtgagaatgtgcagtattggttttccattcttgagttacttcacttaggataatggcctccagttctactcaagttgcggcaaaagacattattccactcatttttatggctgagtagttttccataatgtttccgtggactcatttgtcagtacccaaatcagtagcattgctgtgcaccaacaatgaccaagctgataatcaaagaactcaatcccttttacaatcgctacaaaaataaactaaaatacctagggacatacttgaccaaggaggtgagggatctctacaagaagaactacaaaacactgatgaaagaaatcatagactattcctttccatggaatgataaggaaatggtatttccattttatttatccacttatctattgataggcacttggattggttctatatctttgcaattgtgaattaggctgtgataaaaatacacgtgcaagtgtctttttggtataatgactatttttcctttgggtagatatttggtagtgagattgctggatcaaatggtagttctacttttagttctttgagaaatctccatactgttttctatagatgtttcactaacttatatttccaccagcagtaggtaagtgttccctttctacgacatctgcaccaacatttactgttttttaatttaaattttttttttcataatgaccattctggctggagtaaggtggtatcttgttgtggttttaatttgcatttccctgatgattagtgatgttgaacattttttttctgtgtttcttggccatttgtataacttcttttgagaaatatctgttcatatgattatctcaatagactcttctgagtctattcaataaaattcaataaaatccaacatctctttatgataaaaaccctcaacctggtcaggcgtggtggctcacacctgtaatcccagcactttgggaggccagcgtgggtggatcacttgaggtcaggagtttgagactagcctggccaacatagtgaaacgctatctctatttaaaaaaatataaaaattagccaggcctggttgggggggagcctgtaatcccagctactcgggaggctgaggtaggagaattgcttggacccaggaaacgaggttgcagtgagctgagatcatgccactgcactccatccttagtgacaaagcaagactgcctcaaaacaaaaagaaaagaaaagaaagaaaagaaacaaacaaccgtcaaccaactaggtatagaagaaacatacctcaaagtaataaaaaccacatatgacaaaggcacagccaatataatactgaatggggaaaagttgaaagcattcctcttaagaactggactaagacaaggatgctctctttccctacttctattcaacacagtactggaagtcctagacagagcaatcatgcaagagaaggaaataaaggacatccatattggaaaagaggaaattaaactatctctgtttgccagtgatatgatcttgtacccagaaaaccctaaagattcccccaaaacactcccggatttgatcagtgaattcagtaaaggctcgggttacaaaatctatgtgaagaaatcagtagcgctgctatgatacaatgaccaaactgagaataaaatcaagaactcaaccgcttttataataactggaaaaaaatgaaatacctaggaatatgcttaactaaggaggtgaatgatctccacaaggaaaactacaaaacgctgatgaaagctgacacaaacaaatggacaaacagacaacacaaacaatgggaaaagcatcccatgctcatgcattggaagaatcaatattgtgaaaatggccatactgtccaaagcaatctactttggacaaagattcagtgtgattcttatcaaaatgccaatgccatttttcacagaattagaaaaaacaagcctaaaattcataagaaaccaaaaaaaaaaaaaaaaaaaggaagaaaagaaaagaaaaaagagcctaaatagccaaagcaattccaagaaaaagagcaaagctggaggcatcacattaactcatttccaattgtactaccagactatagtaaccaaaatagcatagtactggtataaaagtagacacgaagaccaatgaagcagaatagagaacccagacataaagccagatacttacaaccaattaattttcaacaaagcagacaaaaatatccactggggaaaggacaccctattcaatacttggttctgggaacactggatagccacaggtggaagaacaaaactagatccctatctctcaccatattcacattaacccaagatggattaaagacgtaaacctaagacctgaaaccttacaaattctagaataaaacctaggagaaacttttctggacattggcctaggcaaagaatttatgcctgagaccccaaaagcaaatgcaacaaaaataaacataagtaaatgggacctaattaactaaaaaacttctgcacagcaaaagaaataatcaaaagagtaaacagacaacctacagaatgggagaaaacgtttgcaaactatacatccaacaaaggactaatatctagaatctacaaggaattcaaacaaataaacaaggaaaagaggccaaataattttattaaaagcaggcaagtgatatgtaaattgtatttttaaaattataacaaaagagtgaaatctagtaaatgttatacctcttggtgtttaggagtgaagtgtactgaggtcttgaaatgcatccaaaattataagttagctttcaatgttcaagttaccttgaaatgtgtccaaaattaagatggattaattgacgggtggattaatggatgatagaggtatacatatgtggataaataggcaggtggatatgtgattaagcaaatataacaaaatattgattctagaatctaacactaggaacatggctgttcactgtgcacttctctcaactttcctttatatttgaacattttcataatgaaatgttctttaaaaaaggaaagctacctgagacaaggtgagaaaattcttaatgcctattcaggtaatactagctgaaaaattgaaaataaactttaagtggagatgattgtcttaatcccaaagtattgctgacacgggatttgttagcatgtctctaaggtgatgcaccatatattttggggaaaagcatttcattttccctgtaaatcatggtgcatcaataatcatgcacttgcaacaagattgtctctgacttctctaacactctagcattgcttatgaaggacattcttctatttggccaacaaagaatatttctgtcttatcttaaaacagagataaggcaaatcattttgacagtctctgaggcaaggtaatccctgctaatctactcatctttctacctcttacatacaaagaatgggctagagtttgtcatgggaccacaggaatcaggctttgtccctgagtttattatttttctgaggcagggtctcgctctgttgcccaggctggagtgcaatagtgtgatcacagctcactgcagcctcgacctcctagactcaagagcttctttcatctaagcctccagggtagctgggattacaggtatgtgccgccatgcctggccaattttttattttttgtagagacagagatctccctgtgtttcccaggctgatcttgagctcctgtgctcaagcaattctcctgccttgacctcccaaagtgctcagattactggtgtgagccatggcatcccacctctgcttcattctaacataccacttcttccctgtttcccggactaaatactcaaggtcattaatagaacattattaaatttgaagacataaaaattctaactttaagctttactaaccaacataacatattgaattttccccaccacaaatttccaatagctggtaaattaatggtgtgttttgtctttcatctttaaatattgaatgaagcacagttctgctagatactcatatcacaatacatgtcttcagaaacaatttatatgcccagtgtatcaatatttaatttatttacacatttttttcatcactacctttatttgaatgatggatgtgttgatgcctaagcccatttatcactaagaatgaaataactaccactgggaaacttttgggaattatatatccatgagcttttcagaactgatcttttgtgacgatggaatggtcactgaccagatccttattgtagactcattacttttgaacacattcatcaataccaaggctcgggtggctgctggatgtcacagatccatagcactgtgccaccacgtgctccctaaaaatctattacatggtttagactatgttttcccaagcttaaacctaggaaaattgattgcctttcccataagtttacataatcagagaaacccagaactggaaagtattttaagcattcattcaggtcaaacatttgtgttctaatagaactttcttaaaatatccaatacaggcaacagcaggtcttattctaaaatatttctggaaaaaaattattccatttagataatgccatgtatgtatccagtccttcactatgtgcagtggtaactagtctaattttaattactgctctttaagccagtattcacctaaacttcataggaatgaatcccttcagtaacatccttatagtagacttcatatatttgtaaagctacataactacatataaaaccaattatgttttttcctagtcatttttatttataatgcatagtctaaactcttttgattttattttagaacagcattatttaaactttcttgctaaatagtaccagagaagcctagaaactcaagaaaaactacttttgaaatattcttgggatctaaatttttgtctttaaaacatgccacataaccttttctcatgtctccatactgaatcaatgcttaccttaaaacaccatattttaacttatgcattagatagaacacttccacacatcaaatgttcaggtaaaatagattatctgtgaacagacttggaatttattctgctgcttgccaaatccttgccatgctgctgtttcctccaatgtggtatgtgtttaaatctggggagcatactctcagtacatcacaagtatagcctattattattgttgttgttattgatgatgctattggtttaccaaaaataatttcctgtgatactaagcacatggctatccaattgaaacacttaacttttactgaggatctgagcattgtcccatggcatattaggatgtgttactgctaaatacccttctgaagatggtgaccgaatccttgaaatgtgtctgttgtggcagtttgaaagacaagtgaacgccaaggtcaggctatcactcagtgaagccaactggctggctgcccacgtttctcataacatttcatttattttgatggattcaccaaggtatgagccctggcactcaggtttggggcacagaaactttgatgtttataagcacattaaatggttccatctctagggtacagattcacattaaccaagggcacaaagactagcaagtaagccacagtgccaaaggataaattgataaagaaaagaaaaatggccttgcagctggcaggatgcgggtcagtgcggtcaggcccttctgtccctgttggcaggtatttcagaaaagctaaatgaacatccagaagttgctgagtgagtgaacatgaaatcaggaaagaaaaaatcagttttatgattaaggtatttagtagtatgaaccgaatgtttccttatccattcatttcttcatagagactcacatatcatggaaatcagagtgggcaagagttgggagggcaatgatggtatttacaccttccaattgttgcacagcttctatagatgtattcagttaaccgtgacgtaggcagtgcctttctctgtagtctgggaacagttctttttcttatgattcaactctgagaaggcagtgctttctttttttcactattacaccatcatgtggtgtaggtgagcttctggaaagggaagaataaaagaaattatgttaactgttcagaaactgtgtgatttagtaacatagagcttcgttacagtaatgtaccctgtaagtggaaagacaggcagtatgggtattacgaaatgatttttttttaatggaagagaatgatggagaaagagacaaaggaaagttatgttagagtcataaaccctgcatgatcctgtaaaaattcatgcttgatccctgcagcctgaatcaacatggacatcagtaaatctctactcttgccgaagaaacaaactaaggctataaagaagtactttgtttttgatactcattgtcttccctgacagccaagtcaaaagatggagataaacaatgagcgattttctaacatgaaaaacaagacaagaaatatctttcttataaaggaatccactcagtctgttagtgtatatactttgccagtcattcctacctgattcaatgaatatttattgattaaagatctagtcttgtgaaagagacacttgaaactggacaaacagatgtagtttgttaagtgctaccagagggataagccaaatgccatgagcagactagggagggatgccttgggagcctcattgaatcattctgaagaagtttgaaaggcagtcatggtgtgggtgggcatgcatttaactagtaggttgacctaggagggaaatatgcttctgcttttagagattaatgaatgtatttatcaaatgtgtattgaaattctaatgcatatcaggcttcgttaacactatggatacactgagcaaaagaaatgagattcagctcacgtacacaagtaggtaaatttttgttttttgtttttgtttttttttggattagcttttgtaaatttacatctagaagtactggtattgttttgtactctctctttcttttgttttttgctttttggggggaaggggacttccaaaatggtattatgacttttcttctttgaaaaagagttcttaaatttatcttcaaaaatctcttgaaaactagaacaaaatgaaaaatgactaggactgcattgttaaccttatcaattgtgactatcaatatggaatccttacacctatgtagtttatgaaggcaaagcctacagttagtttgagacaactattaagcctgaccaaattctcagaatgcttttatgatgctaataagtatcactacaaaatgaattgatgtttctcatgcagccaaagtggcaatgattttacaggagggagaggcatgaggttggttatctcttcctggcagatgggctgtccctccccaacccctcctcccgacacagacacaggttggtaggattttttctacctacaggttggtaggattctctgggagaatgaaaatatttttaaaaagcaaaacaaaggaaaactcttaatttatatttaaattacccataatcgaatgattcacgcaaaatgaacttttagagcaaacgtcttttcaaattgtatgagggatggcttatttttaactaacggtactgacaggacattctggggactgctgcagatactggctgctctattcacaaagactagggggaagaaaaggctgtcttcagtaatgaatggaaacactgactggctttgaggcgagtaattgccttactcacccacacaaaaatttcagccagaaaagtcctcctttaagcagagcacaaatgatgtgaaatgcatacttgcacagatatagtataacttaccttgagtttatttaattattcctggtccatgggatttttgaaaaattgccagaatactacttttctgcagatataaataaaaggtccaaatgttgcttaacttcttttttcctgaattgcatagtatatatgtgttagaaatggctaataaccgtcacagagtagttgagaagttaaaacacacacaaattcttaatatttctaattaaaagcagcataggaatattgattactacagtggaaatgtaatgtgttctttctttcctttttaaatgcctatatggtacttattaacacttttaatggcaaaagcaataaaaataattaaaagcacatttagttcctgttctgcctcatttcattaatttctgcttttttttcttttggagaaaaagttgtaaaattgatgtcttagctgtagctgcctctttatgatattagatttctgtatgtaaagaaggtattagaaaaattttctcctgcactcaaggaatctttaaacttaaaataaaaagtgattataccttctattttcaaggcagaataaaaatgttttacaatgaatagaattcttgattttcaaagaagtttattacatttgattttgtcagagttaataagtgataataaataaatgtgtggaaaaataaacttttgaactagatcaaatgtgtttgtttctatttcagtattggctttgatgcctaagaaagcaaaatatttatctactgaaagagcttatgtctttgtggcccccagcttttcctctggtgagccttaggaaaaatggcacttgctctggaggcagggaggaaactccagatcagacccaggtttctggcttgggaggtggtggtggtggtgaaggaagtgcagttggttaagataaggagatgaggtgaattgccaaattttcacccagatgctcggcggcctctaaaggtcggtggtgttaccaggcgcaaattagtaatgctggctttgaacttaccttgaagctgcagtgccacttgttcttttcatgcagtcgtatttcgccaatggctttttactattttcttaacctatgtttggcatcttacctgactcctgggcaattacaacctttaaccactagaaaaggaagtacattaaacacaccttgttcatcttgaagagagagcaggggaatgggggtttcctcagcctgggatgactttcttctgcctttcagatctaagctctttctgacctggatcttatttaactgggaaacggccaggatagatttgatctttagcgtttctaacaaacatcatcagggatctctctttcctgaatcctatcacatttagcatcttgcaccacagtgctgagtatttttaaaaatataattttctcttttgttcttctgatgtttaatacattattcatcttcccaaatagattctcatttatctgggtgcaataagttcatctagagtccttccttacctactttccttcctttcttctttcatgcattccttcttccctccattagtaataggctgactctatactaagacttcaaaaatgtgcatgttctttaagagtttacagatgttctaaaactgactgtttcagaggaactactttccttgactcaataatagttaatcctcaagaacgattatgtatagtttttttaattcttcaactttgtgagatgtggttataaaacttaaattgatatagatgaaacagtttataaatagttttcacttgcattatttcttggaaagctcgtaaatactgtatgcaagtatcccctccattttctatgtgagcagcatgagcctgtattatatctacgaagtaaatgagtgggggtaggttttgtgacatgctggctgcatcagataatgctgcatggcataagctgggcacacactgctgttcctgttttatgcctaggaagatgaaagccttatcttaaatcataaaagtaattattaatgggcagcccaggtgggcagaccaggctgccaagtttactattttctatcgctctacaatgaatattccacattaggtatagattatctgttgtcaagagagttttatatcacactttgatataaaattaagtgtaaaaagctattgagaatcaatatttgacattctaaaagtaacttcaagatgataaagaataaatattatactaagcccaaaaatagtttctgggtttgttatattcatctgtttaataaatataagtggatgcgtggtgcaccaagaacttagcttggcattgaaaatgcaatgagaagtaactatgttctctactctccttgtggacaagagtctagtctgttaactagaaactacttctagatgattgggctgcaaatatgatccttctgctatgttttgcctagaactttaggcagaactttagttctaggcagaatgtagcagaagattatatatgcagcctgctcatcccctgaaatcaagcttaaagatgatggtctgccttgttagtaatccgtagaggcttatcaatcccagaaattttgggctattgttccagtctgtagatcactgacattcttttagtgctctttcaaccacaatttatagttcccaggatgggtcaacaactgtactcctgggatgtcttttctctctgtgtttgagatgcagatagctagttatccgccagtcctcacaatgctgaaatgcatccctcaagattaaagattctattcctaactttaaggaataaatctgagcttagtgcttcagtccaaatattttgtgaatacttagtatgtgctttactaggtgttatggatacagaaatgagtgtgaaatagtctctgacctggtagaactcaatttagacttaaacataatttggaaaataacacgtatggaggaagattcataagcctgatcatgtgtgttaggcataactagttaggcttataattatgcttaaatggattagatcaaccgtgtatgtaacagagctagtaaatagataattagatattaaaatgcaggtgtactgattccgaagccactaactcgtaatgcatctaccaaattcctctgagtgtaagattgttcattttagcagtttcagaactgtgtcactccaggacttaatctgtatggtaggggttctccaatttgagtgtgcacaggaatcatctggagagcttggtacaacaaagattgctcagtccttccctccccaggaactcactaggtctgagctggggatgaataatttgcatttatataaactcaggggtgaagctgaccatattttgagtagcactgaccttggggactgtttcccagacttcagcacatagtagagccatctggagagcctgttaaaagtggctgttaggacttccctggccctggagattcagaagggctgtgatggggctgaataatttttattttcaacaagctttcagatgatgctgatcctactggtccatggactgcactgagctaaggcattgtctaaataggtagacagaagtaacctactaagaaactcaattttgaaaaatatgaaggcttgatcaaaatatgtactctccttagcatggagtcctttcatcagagaaatgggaaaaagtaaaagtaggaaactaaatggcatgaatctcatgggcaattttaagaagcagtaggcactctaaatagcaactgactttgatatgtatggaggatgttttacatatattgggagaagattgtctgtctgaataatgtaactgtagaaagacccttagctttgtgtctatttagaggtcaatttcagtttctatccctctttttaaaaatatcttgtccgtgtattctgttcctaacattaacatataaggttgatagaaaatatggataatataaaaagtggtattgaatgatatcactagaaatagtgttcatgtaaagaaaagatatgggccagcaccaagttctgggcaactccacaattttgagaaattggaagagtggctggcaaataacaaacaggaaagtatggtgtcacaggagccaagaaaatgttctcgtgggaggcttcagcagtgaaaggattggaatgctgataagaaatactgtaagatgatggaagaattggctgtctaacttggctccatggagatcacgatatttctcattggaatgttttgctcaaccctaattgtccttctttgcagaatgaaagtcttgtgggaaaatagagattaaaatataactaattctgtctataaattatatagacatatataagaaatatataaattcaatctataaaatagaactaatgtgtttgtgtgcatgcaacatttttccgtgaaatatagttttgcttctgtatttttctgttcttattcatgccacacattattcattagcacagatttatattccattttgataactgatatccacagatattgttttcaaaattattattttatatgattatttttccatctaaattttaaaatcactttatcaattaagaaaaaagttttatttggattttcactggaattactttaaatttgcagattaatctaggaagaagggacatctttaccacattgaattttccttaacagggatttgaagattctctacatccttcaagtggtcctataaattctctaataacattttgtggttttccctctttgggcaataatactttctaaagacatttaatatattgttttgctattataaatgctgtttttatatgtttttattatagtactgttcattgacattaagtacatttgcgttgctgtgcaaccatcaccaccagccgtctctagaacttttttcatcttatcaaactgaaactgcataaccattaaaaagataacttcccattttttcctctcttcagcccctaacaactaccattctgccttctgtctctaagtatttgactactcgacgcacgtcgtttaagtggaatgatacagtatttgtccgtttgtgactggctttattccccttaacacagtgtttttaaagttcatctatgttgtagcaactgtcgggatttccttcattttcaaagctgcataatactcatacatacacacacaggcatacacacaacattttgttattcttttcatttaccaatgatcatctgggttgtttccaccttttggctattgtaaataatgcttctgtgaacagaggtgtacaaatatctgtttgcatcactgctttcaattgttttgggtatataaccagaagtggaattactattgattattaatgataatcctgttttactgttttgttagatatatcacaatatgaattcccagctacaattttggggtcattttaaatactctcagttttctcatgtaccattttcttgattttctttagtttgtcattacttttctttagctctcagagtgtatttaaggcagttgttttaaagtctttctctagtaaatctgaagccttgtttctttaaggttggtttccagagatttattttgatcttttgaaagggctggatttccctgtttctttatatgccttgtgatcttttgttgaaaattgggtgtctgaaaaatcagacacttcttccagtcactgtagactgtgtggaggaagatgttctctaaatagcccggtatgaaagtttaagattttctcaggcattttctaggtctgtgtcttccctgggcctgtgtgtgtggtgttctctcccaatttccccatagacggggctgcttttatttatttatttattttgaaggctgctttgaaatgttttattatccgtccctaagagtttcacccctgcttcttcgtgaaatcttggctgttcctctgtactactcttgccttaacaaacatcttgcccccagtttctgcatgtcagcatactcttgcagttttcacaaactatgttacccatcacagttttgcatggcttccaaactgagattcaaactatatattcattttcgtctgagagctccaattgaggcaagacagaaaccagtccctcaggcagcccacagacaggccagaactttgcaaaataagttccactgccctccttccttcctgagagaaaaatactggaaagtgggctacttttttttttttttttttttaactgcactcactgttccaaggtggcgcaagcacaagcaataatgccgtgaaatgtcctacctttttcactgtggctttttcttgatggggcattcacttggttggaaagcagtgaatttggctggttaccagagctcccaaaaagctgttttagtgagtcgctagtagtttacttgatgatcctgtggaggaatgaggacctggagctttctaatctgccatctttctgatatcaaatctgtttgtttgtattttgtcttttttagtagctttattgtagtttttaaccctaaatgtgtccagaatcacagttgcttagtcctgtcttagacctctaaatcgtgatgctaaaagtgtaaaactaacaccacacaatatattaaggatagctgtcatacttattttgtttctaatttactgttaattcatctaggagtgtgtatgagttcgttttgacattactataaataactatctgacactaggtaatttatgaagaaaagagtttaattgactcccagttccacaggcttaacaggaagtatgactggacggcctcagaaaacttaccatcatggtggaaggcaaaggggaagcaaatacatgttaccatggcggagcaggagagagagtgagtgaagggggaagtgccacacgcttttaaaccatcacgtcttgtgagaactcactcactatcatgagaagagcaagagggaaatctgccccccgtcatccaccaggccccttctccagttgatcccactaggccccttctccaccatgatattttggtagggccacaaatccaaaccatatccaagtgtgcaccaataatcgtaattattggggagtgataaatgtgaattgcaactcatataattgcgagttcttttataaacaaattaattgtaaaaaaacaaacccaagcttaggcaacatagcaagaccccatctctacacaaaatatatagaaaaaaagtagccaggtatagtggtacatttctgtggtcccagctacttgggaggctgaggtgggaggatcacatgagcccaggaggttgatactacagtgagccatgattgtgccagagcaggaccctatctcaaaaacaaaaacaagaaaaacaatcccggaacaaaataaataaaacaaacaaaaaagagcaacaaaagacacttgcttggcatttctaacaagcttccagctgatgttgatgcctttgtaccatagctcagattccagtatgatttagcatatttaaccttatgtaggtcaacagcataaacctataaagagtataattttgaaaaatgtgtaacttgtaataagttataaaaaaattactttactcagcatagagtcctctaatcatagaagaaggataaatgaggaaactgtgaatggcatgagagcaatgagcaattttaagaagcagtaggcggagtaagtattaagtgcaacttaaatataagaaataatctctatgattatattttctttattggtattcttaactgatgtcttgtaggaaaccatgactgtttctcctaatactagacaatagtccataatgtttgttatttatactaaactcttacattcaattgactaaagttgtctttagtataattacatttatttctttaaattgaatttgaattttctttttgtggtatttttttcagacatactattcagatgacacgaacttaataaaaatttagaatttttttctgccttcaatatgttataaaatattttaaatagtgcaaaagttatttgtttcttggaggcaaaaatcagattttgccttcttcttttggaaactccttgaaagttatctcagttccttttatgcttattaatctaatatagcttgtaaatgttgtcaattattttttccagaaggaaaagaaatgcacattttgtggacatttccaaatacctacatgtgtatttttatacacattctctacttttaaaaaaactcctctgattcctttttcattctagattttgtatagttacataatcccagcatatccagcaccttttttataggatgttgattgaatgtgcatagtgaatgttttatatcaatataagaaaattaataatttttttctttatttcccatagcaaaattttatgatttattcttttacctttattttttttaaccttgtattgtattattgcctagaaaattctttctcagactttatgctcactgggaacaggtcttattttaatttgtattcccagcttcatcttgtgtggtatcccaaaccttaacacactccagtacattttgttaaatggtaaatggtattatttaaggaaatttaaattgaatttctatatctcaaggcttttcaagccagagctggctaaacatttcttaggtgtgttgtaagagcatgtttctttaagatggagtttattccaggtatcttttaaagttttaactcttaaatgctgtttctttaatatcatgagacaatatagaaactcttaaaatattttaacttcctttaggatattttcggattattcagcataaatgtctttgaactatttcaaacctttccatatttgacattacttaccgttgaaaatataaacaccatcagtaaaataaaataactaaaagacagttcaaacttttgagctatttaacagaacgtgaactgatggaagaggagaccccattttttttttaattttgaggaactttattgaacttctttgagaaaacattaagattctatgtgaagatgtattgaagcaagtcaatatagggaagggataaaagaaagtgagtaaataagcttttgagtgattggtgtgattgggttaagaatgacgctaagaacgaacgtaaacagtgttcacactctagggctaaaaacccaagtacatcttttcacacggaaatacagatatttttaagaaccttccttgtgcttcttagaaagtagacaggtggttggagaaaatctatttttgttaaaacacacccacattcaatctagatgtataatttcaatatctcaatgatttttccttgtattttctctaaatgtcatgcttttcagactatttcaatatagatggattatatttcttttcagaatacatatggcagataaatacattgacgttttccaaaggaaagtacaaatggaatactatttcttaaaaaaacaaattttggtatcctttacttccttatgaagaaaagcaaatccgctggttaagattttttctttattttgccaaataaaatggtgtattacccttgcatttttcctacttattattcccagcatttttctccttgcacctaaacaaataaaaaatgaatttggacttagataaattatctttatagtggtaagccttgtctggtaaactaaactgttccctgaaggatgatgagtaatttgttgctggtagatgtaatgtaaatagttaggttacagactcagtttagtttggactatagcactaacgtgtctctaggcaatcacaatgtttaatatgatctgacgttgaacacaagcgtttcaactgatgcatccatccaccggggggctcatttacaaaagtagcaccatctatggatcatttaatgtttgcccctaagtttctagaccccctccttgtgatatcataatctaacatgcactttgttctgtgaccaaagcatccagatgaccatgttgcaagttcctaacatgttccttgtctaaggctgctgcccaggatcatacctgttctgttggtctggcatgtgcaattgattgctttcagatgttgggtggtagaaagccatcaaaaacaaagtcaatcaggatcactttcaccaccacttaattaactggctaattactttctaagcacctattaagagaacaagagattgttaactgacgtaaggaatctaaaattgtctaaggctgggtgtagtggcttatggttttaatcccagagctttgggagactgacacaggaggattgcttgaggccaggagtttgagatcagcctgggcaacatagaagacctcgtctttacaaaaaataattttaaaaaattaactgtgtgtgatggcactatgcctgtcatcctagctactcagaaggcataggcaggaagatgacttgagcccaggagtttgaggtttcagtgagctatgattgtgccatgggactccagcctgggtgacagagcaagaccctctctctaacaacatttttttaaattaaaaaaaaaataaaattttctaagatgtgattcttacattaaggagttaataactttaaacccaacagggatatgagggatctttatacatggttttaagcaacaccaacactaccattcaccatcatcattatgacgatgatgatgtcattcattcatgacataatgaatgatgagaaagagtacaagtatattgagggagaacattccaaacagttcacttagtgtaaactttcttatcatatacttaggtaagagttttttttatgagttattttattttaatccttccaacatttaaaaataattgtcattattattccagttgttcaggtaaaaattttgaggctcagaataatttagaagtgtgtttgcagtctcctagctctcaagtagcggagttggattcaaacttactggtacagtgtattttaggcacttttctttccagagaaaggaaagtcatatctggcttgcataactaggagaaattcccaagagaagagacatttgagcaggatgttgaatgactgacagtgtctataactggatgcatatgaaaggggttggatggaacagaattaggaatggaatggtgatgtgaaggttgaagcatctgaggcaaacgtaaggaaatggtaatcagagcagcatgaaatacaagattctttctcaaaagcagattgtgctggctggggaaacgggagcgtggatacagataattattcttctagactgacacatttgtgtttgattctttagccagtgtagggatgttaaagaactttggagaaaaaaagtaacgtaagtaacaccatgctttagaaatgtaatggtaatagaatataaggtggatggaaaggggagaattatattacattcattaagtcagcagttctcaaatagggacttgtatatgccttgagcattgatgagtcatttcagaggaaccacacattcttatgtgcatcactttatgaacagaaaaatatgtctcgctcaaatttgttttaccactttttaaatggtggacttccgtagccagctgtgacttggaaaatatacatttatttgcaaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggttaagtgtgatctttataatcagattttatgaactagaactccagctctcctacttattagtgataaaaggatatgttactaatctcttcaaatcccgttttcttatctgcaaatttgtgaagatgacactaatcttaccagattattttgaggattatgtgagattgcaaatctaaaatatttcaataccagacacataataatatatataagctattattactctttgttagactatgtctggtagacattacatggttttatcatattcacaaactgaaaaacacagtcaaaagtcatttctcaaatggtttgtcatgagttggagtgacagcatatcaagatcataatcagtaaatttcagtttataattttttcttgattctcttactgaattgaaaagtcagttataattgctacatttctattctttttcctgttcttacattgtgaaacaataatatgtgcttgcttctgttagagttaataaataggaaagtatttatggttcttggcccagatacccattcgctgttggttactgccctttttttcactgtctcagttcttgagatgagtatttcccaactttcagaccactgtaggttttgatttacagcagcagcctctctcgttctgtcactctaccttctgagtagccttgaagtagggcatcattatagagaatcagcaatcatcacagcacacacattctaacaaagaaactcacctagaaacttgcaggaacgttgcattccagataagggtttatggtcacaaggcaactattgactgtctttatatcacttctctaaagctgataatttgggggacccactgtattgatttacgtggaaaatatgaatgagaatcctaaagtgcaagaggaatagaagtgttggataataagcattatttgaaaaagaggtgtggagcaagtcatttaagaaaaagtggaattgatctctcctggatttggtttatcagaatgaaagactaacttagagcgatttatctgagaagggaaacaacaaacaacaaaatgcctcctatgcatggtttcttcttgtatttatttagagtctagttctttaaatctgccgggtttatggcacaattcaataccaaaataactatatgaatattgacatcaatgttttaatctgtgagtcacaggaactcatgtacaaatttattaaatgttttctattctgtttatatttgttgacaacaaagcggctctacggcttctggtgtgatttgtgcacatgtagtgagctggatatcttcatattttgtttcatttatcaccaaatctgttagctatttctaaataaagaggctgtattgagaaaggatgaaaagcagttgggaaatggagtaggaagaaaaaaatgagaagctcagtgttttataaactgtattgcaaaaaaagctgactttcatttcaaatcattgtggtctgtgctttgctttggtgaattatgcccacacatatctagtcaacacaggagagcacagatcattggaggaatgaatagctttaccacatgcatcgtgagagatgtacaagtttattttccccatcaaccatacctttttccaatatcatgcatgttgcccagcaagacagtgtcattaaccactggtatagaaggactcatttaatttagttaactaaatcctgttttttttttttttttttttttatgagtggtgggagaactgtttaaaaaagacctgtttggttaacaaatgtgcgctgctctgcagtgagggacattttgaatgattttcccatttctagtctttgccccatccagttagaaagtagcccgtagtgcttcaagaacatttacatttacatctttattgtaggttccattgtagcaagaatacatgtaaatggactcgctctatttcaataattattttgcagagtattttggctatcatcctggtgtttatagtcaatgcatttttacaccatctacattttggacagcaagcataaaacgctgctggtttatctcacagagagagcagattgtcccccaaaagatagccatttataatatgtgcacttttgaataattaaatgaactactgaagaggaaatggattctaatcagctttcaaactgtgattgtgccatgcactgaatcattcctttatgaatacatttctcttggagcatgaataattacaaaacttttttttctatctcggtaggaactgggaagtaacagccctccacagagaaactggaagggaattgctattgctctgctggtgattttagttgtatgctcactcatcactatgtcagtcatcctcttaaccccaggtaatctgtctttattcctctcttatgatggatggtattgtggatgataatttcgcattcaaatgccttaagagggtagcaatatgtggtatcttagggcacattagcatgggttggaatttggaaaaaaagcataatcagacattttgcaaatggcacagtaattctgcagttcaaatatcatgcaggatattttggggaagctgaaaatgtaaaatatgtaagttgagaatgccaaggagatttttggtctccattgccacttacagacttactatgtgttagtttgataaatgcagaagacatttgacttttattgtgggttgaagatgagggagtggcatctggaagtttctatatatagatgataacccaactgtatggaaatggaaagacaggatttgatggaaaaagatcagatcgaaagagagtgatctaagcctctaaatttggacacctatttcttgtgtcttcttttcctttctttcctaaagtttttacattctaagtttctaccctatctaaagaaactttgcaaattgcccctgcaatgatttttggactgtgttcttcagattaaagagtttaatactaatatggaaattatcattgtgcttctttctggggactatttcaatacccaggagattcattactctttagtaggtactaataaggaaggcagagataaagggatcacttttaaactccttcagttgtcttccagatacatttagcagttgctgcaacccacccacccaactgtttttctcaaagaccaaacacccacatatgacacagtgttatgaaaaatagtcatttctgggataggattgaatgaatccaaaaatcaactgatatttttaaattatagcctgttgttgaatgctatttatttccacttcaggtttgtcttagttttgttattttatgagccccttaaacacattgaacttatttcctgatgtacaaaatatgattaacaataactgtttttcagagtcatttagtcaaataattttggtgactaattatacaaatggcagtatcaattgttccagtgagacacttcgtgagatataccatctttgaaaaatactgacattgaaataaataaactgccaaaaatgcagtttttagatgttagttaacatgtggagaggttgagaaagaaattaagggagctactagggaggaaggaggagagaaaggtaattggaaaggaagaaagaaaaaattccctggtaaaagttggcttatccggcattctccccaggaaccttttcttaactgcctcatttgtacatctgcagtacaatgtcattgagcaatgtgatggctctaagttgctgcataatgccaagaatcattgttacaggaagatgagtttcagcatggtgtttcacttaaacacaagaagtttaacataattataaaaaaagaatgagtcgacattgctgccttctattgatggctattagccagatggaggtattcatgtcataatccctgtgtatttctcttgaactctttttctttcatcctggttctagcatccttggcccagtgattcactttctcaggttttcttgttactcattgaggccatagtgatattttggtgtccttgagagtttgatacaacaaagaccacatagagtgaggcactcactaagttaaacttctgctcaacccttttcaatttttcccagtataaaaccacagtgatgaaccataattgagttcattttgtcctgcacttattcatttgttaaagcaagaacaagcgtgacatacctgagtttgagttctgcctctgtaatacagtagttttgtgcaatttggcaagttatttaaccttctctctcactttactcatctgcatgatgggtataatatttagttccaacattgcagtgttattatggaggtaaaatgagataatgtagttcaagagtttatttagcatgctgcctagcactgctgctgctattcctttgatgattgctattattcagtacttattgaccaccagaaaccatgacaagcagtgttatataaagaatgttccccagaaaaggtataaaacctctcaggaatatacatcttctgtgacttcaattttagttatgacaaacggaaagggacaaaatatttaacctgaagttagtctcctggggtcaaattattcatgcattcattcatcccataggtaattgtggagttctcaccacattctaggtgctgttgtagttggccctgcactttcgctattttataactttcacctccaatcccgttacacaaatacaaacatttagaaaatacacatatttagaacaccacagccccccaactcagacttaatttcatatgatattaatcatataaatagaagtggcatttatttatttatttatgttttgttttaagatggggtctcgctctgttgctcaggctggactgcagtggtgcaatcatggctcactgcagtcttgaacttccgggctcaagcgatcctcccacctcagcctcctgagtagctgggaccaccatgcctggttatgttttattcttattgttatagagatagggtctctctgtgttgtccaggctggtctcgaactcctggtctcaagcagttctcttgcctaggcctcccaaagtgctgggattacaatcataagccaccacacccagcccacaattattatttagatttacagtttaccaagtgcatttcacatactacatgttcaaatgtctttggatttcactattattattggtagggacattataaaataaaaaagaaaataataatgctggagtggaaaaggtattgctgtaggaagcagacaccctactttatacagagagtgttctatactttctgcaaactcaatgccctcaagtgcctagaagattatgtaaattgatcaagtgggcaagtataacaactagtggttagaaatttgagttgtgacccagcaaaatggcagtgtagtcgcatggcctttacggtgggctcaacccaaacatgtcagagtaatacataaggccagaagactaatagtttgcagctcaagacttgagtcttcagcctggaagaacttttagaaatgatctagtcttgcctctctcatcagacaggaagaatatctgagtttgtttaacttttggggtgagaacaagaatatccatcaaggccatgtacactcttgattttgcgtgtgtctggctgtgtacgtctgtggtcagcctgcagtgctccaactgcaccaagcctttctcttctaaccctcaggcttgagttctctcagctgtgctaaaacagagccataaagaaaacctccagctggaaattaaacatgcagcatcatccctctgatcttccctctgtccaccaatatgttctcaaggcctagctttctaagtaaaaccagtcaagcaggtggaaactttcaaccaagtagaggaatctatgtcaggaggggaagcttctgactgtggaaattcagcaagacactgggccttttaggacaaggcctgcctctagaacaactcttccaataagagtggcagtcaggccggacgcgatggctcacacctataatcccagcactttgggaggccgaggtgggaggatcacgaggtctggagttcgagaccatcctggccaacatggtgaaaccccatatctactaaaaatacaaaaaatgagccgggcatggtggcatgcacctgtagtcccagctactcgggaggctgaggcaggagaattgcttgaacctgggagtcagaggttgcagtgagcccagatcgcaccactgcacttcagcctggtgacagaacgagactctgtctcaaaaaataaaaaagagtggcagtcataaattcatatagcttttataattatacaaccctgggctagtcactaacttctatggcttcagtgtttcattgaagaaaaggacatctttggtttgctaaaatgtgaggtgatctcttgaagtgtattataactctaatgtctattatctaatatattaataacagctaccaatgataataatgccttgtttagtgacaaatatagcaacagatgaaatatggtgggctctttcactaagatttttctaccatgaaaatatatttagtgggttggttttgaagatgaaagcatacaaaaagttatttagtcaaagaaatgttttagaaactgttttactcaaaatagcacacaatttgcaggtaagtctaaggaatgcaagcctataaccagagaaacacatgttcactgtaatttcggtttgattgcaaattttattacagaagtagtttgacacatgtgccttaatttctaaaattatcagactcttccttgccttgtgaagagaagtcctaactatttttgaagaataggctattcaagcatttcattttataagtatttctgaaaggaacaaattattcattccatttttttaattacagggtggacttattcagatgcattgatgaagcctacattattttttctattgagtttgtttaaagagaaggagtttacccacgtttattttgagaatatgttaactataagatcaataattatactctacaaatatatgagtgtacattaatgcttaaagttgtagaaatcagtctagtaaaggtatgcatctactttgcaatcttgtttttacatttaatatgtagaatgagaaggaatatacttgggagaacattttgtgcagaatagaattaccaattttggcctgttttaagaacaaaggtgcatattttatgagtcagaatgcagttgatacaggatagtcatcaggctctttaatccatctgccatactgaaatagccacctgcgaactgtgtatactccacagttcttcagcaacaatggcctgttgccctttgactgtgtctgtaatcggtcaatgccgagacagagtcatcacactgattatctgtcatgctgactaagggtaaaacgggaaagcaccaaaatgtggtcttcattgttagctctagctcctgtttcttttggaaacttcccaattaccctctgttacaatagtgggattcattcctttagtacactttttaggtgtgcacagtagatggtctttgcaggtttatcagaatataaacataaccaagcattgatgtgggaatcatgagagctctgcttgatctcagttaaacaagaatttaatggtaatttttcagttccgcaatagagatgtctttattttcacttctagaagtgtctctaagattaagaattttaaactaatttcataggccatgttgggtaataacttacccaggtcgatactgccacagtgatgttgatgattagataagtctttaatatcagatatgtgttacatccatgaagctatgctcaattagttcatttgagtcaaaacagagaattaagcaagtgaaggaaactagagaaacataggcagccctattcagaaaaatcaacaaaagaaaccaaaaactagaagacagcatttaaggtattatgccttttttacatcaacctaaatgtacagtgcacacaatcaactcatttaaccctcataacacaccagtttaaaggaagtagagcagttttctacataacacagctagggccaatagatttggatgacttcagcagctagtttgtggagaaagtatagtagatagagtgactaaattgaccttggtattcgactgacttggattcatctcctagccttactatgtgcccacaaatatgatgttgaggtaaagaatcctctctgttcctattgttaagacaacagattaaaaaaaaaagatttgaccctttgaaagagggctttaaaaatattcatatgcctgcacacacacacatgcacacacacacatacacacacacacacacacatacatctatatgtaaaactcatttcctagaaagcatttaataaaattaaggactttattggactgatgacagctgatctgttattgttatgcaaaaactcaaagtgaattcattctagttactattttgctctaacaaaatgacagctcctggttatagttagttaaaatgttatgttgtactatattgcagacaatatcttggcatctgtaatttattaggtgtcatttaagcacctgacctgtgttttaaaatgtcaaagcaatgattaaactatccccattatgcattatgaggggaaaataatgttttaccagatttttagatttgtactacttgtaaacatcggcatcaatcaagatgcaaattgtttattttgttgaattaaagcaggagatgtgctgtattgataggcatagtctaatgtgtctctgcttgtttttttcaacaacagcacagattgaacatggatttccatgtagcattacccaggcataatcaggctgcagagaaaacaatgacagattctaacagtttccccctggataatatggattgttgttgcttttttaaatagatttatctctgatgttgaataaaaaataatttcctctggcattaacggaataaaaacagttacttttttgtctttcctttatagtttcatttctatatttaagccatatgtgattcccttagttactctcataatgttagagtgtccagtcagataaatgatgaatttggtttacattataatgtgtttagttttacaagagtcagaagagaacctataaacatttatgtatatctttttcttgccagatgttgtactaagtgctttacatgtactattttttctcacatcactaatattgcatagatactattcatttatttacattctagagtattcatctgagtcttacaagttgaagtaaattgactaatttcacacaactagaaggcagagatgctcgatcactctctcaggcacttttagctttgacatgtgtcataatccttgtaatataagttaagacatattcttgtgcccatggatgataggggcaaaaaaatattttagaaaaataaatttcccctttattctttcctatgatttttgtaattagtaaactaattctatgtatttctaaaagggaaggcatagcagagaaagaattcagctgaggattgaggtgtaaaaatttggacaaggggcagaaagggaggcagtgacagaagtgggaagttgaaaatcgtaagtgtaaattctgtatgtatttttatttctggtttcataatttttcagaacttcaaatacccatgataaaatataagttcatattttccatcctaaaccacattatataaaattgtgtgtcattatacaactttaatagtttgtcatatattttatttcttcttcctaatagaaatttgatttagaaatgtgatattctggcctctaatgtatgattagatagtctggtctctgagaagtcaggtttccataaaagcgagagttatggtggggtttggtggctcatgcctgtaatcccagcacttgaggaggccaaggcaggaggatcacttgagcctaggaattcaaaaccatcctgggccacatagtgagaccccatcgcaactaaaagttttttaaaacaattagccaggtttgttggcacatgctactcaggaggcaggaggattgcttgagacggagaagttgaggctgtagtgagccatgatcatgccactgcactccaagctgggcaagagagcatgactctgtccaaaacagtcttccatctagttccaaaacatattcatcaccccaaaaggaaactctacccattaagcagttgctcctcatatcccacctcagttgctcctcatatcccacctccctcatcccctggcaatcaccaatctacttctgttctctgaagatctactttttctagatatttcacataaatggaatcaaataacatgtgacctttagtgtctaacatctttcactttgcatgttttagaagttcatccaccaagtcacttgtaacagtgcttcatccctttttatggctcatagcaatccattgtatgcatattccagagattgtgctactgtgaacctgtgtgtatttgtttgagtccatgtttttagtgtttggggttatatacctaggaatggaattgctagatcctatggtaatttctgtgtttaaatgtctgaagaactatttgccacagcagctgaaccatcttacattcccaacagaaatattcatgtgttccagtttctccaaattcttagaaacacttgttcttttcttttttttttttttcaattatgggcattcaagagatatgaagtagtatctcatttggttttaatttgcatttccctaataattaactatgttgactgagtatcttcttatgtgtctattggccatttatatatcttctttaaagatagatctatttaagcctgttgcccattttaagggacttgctggttttactgatagtgagttgtaggagttctttattccggatattaatctcttgtcagaaacatattttcatatactttcttctataatgtaggttgtctctttactttcataatagtttcatttggtgcacaaagttcttcattcacctgttctttcattgcttgtgcttctgatgtcttatttaagaatacactgctgaatccaaggtcacaaagatctgtcttttgttttttttaaatgagtttatggttttagtttatctacatgggtcattgattcattttgagttaattttttttatggtgtgagttagggagtctagctttaatttttgcatgtgaataaccatttcacccagcaccatttattgaagagaccattctttcccaattattattgtgtgaaccttccttggttatagatatatgagttatttctgggcttataattttacttcattcatctctatatctgtcctcatgctggtactgcattgtttggattactgcacctttgtggaatgtttgaaatctggaagtgtgactattacactttaaaaatatatatattgctttgctatgaagagcccatcacagttccatataaatttgagaattagcttttttatttctgcaagaaagccagttgggattttaatagtaattgcattgagtctgtatttgctttaggtaatattaccatcttagaaatattagtgttccaactcataaatatggaatgtcttttcattctggaaataatttaaataaaacaaaaatcaacattttgtagtttatagtgtaaaagtttttcatacttggttaaattcatttctatttagtttattcttctttatgatactgtaaatagaaccttaatattcttttctgattaatcattgttggtatacagaaacatgactgattgtttagtgttgaccttgtactcttcaactttgttgaaatcatctattagctttagtagcttattgtagattatctgagattttctatgtatgaggatcatgtcatgtgtgaacagagatagttttacttcttcatgtccaaattgaccatcttttagttctttttcttgtctagttactctggctagaatttccagtacaatgctggataacaatggtaaaagtggatattctcgtcttattccatcataggtggaaagctttcagtctttattcattgagtagtcttagcttgtttagataaagattctttacattgttgagggagattctttttatttctagctcttaaaatatttttataaggagtgttggatattgtcaaatagattttatcaataaattgagatgatcatttgttttcctcccttttctactatatgttgtattacattgattttcttttgctgagccactcttatattcctggaataaaacccacttgttcatgatgtataagcctcttcatatgctgaagaactcagttttctaatatacctgaaggatttttacatctgtatttataagagatattgatctgttggtttcttttcttgtgctatctttgtctaggtttcatatcaaaataatttttaacctcacagaatgagatagtaatcttttcttgtacagttttgggaggagtttgagaaagatgagtgttaattcttctaaatgttagaattcacaagtgaagtcatctggttctagcctttctattgttaggaaggtttttgattaatgattttgtaacttactcattataggtctgttcaggcattttatttcttcttgaataagtttggtagtttgcgtttttctagaaacttgtttacatcatataatgtcttagttcatttgtgctgctatagcaaaataccacagactgggtaatataaacaatagtaaattatttctcacagttctgcaagctggagaaagtccaagatcaaggttctagcaggactggtgtctggagagggctgctctctgcttccaagatgatacctttttgctgcactctccagagggaaggaacactgcattctcacatggcagaaggaacagaaggaaaagacagccttcccttcaatcctaagctcttttataagggtattaatttcattcgtaatggtagggccctaataattacctctcaaagttcacacttctcagtattattgctttggggattaaatttcaatatgaatttggaaggggaatataatcattcaaaccatagcatataatttgtatctgtattgtttgatacatatatgtttattattttgtctctttaatgaccatttttcaatatatagtatcacttcttctcataacaatttttgacttaaagtctaatttttctgatatgaggataacaaattctgctctttcttgattacagtttgcaaagaatatatttttccatcatttaccctcaatgcattgcatctttagaaagcaagtaagtgaattttaaaaatccattctgccattttcagccttttgaatggagaattacatttatttacatttaatttcttaaaatgaagtaattgtttcattgttccatttgttttctgtttgtccttttacgtgttttttttctttaagtccttcaatgctgctttcttttgtgtttatttttataatgcccttctttgatctcttctcatttcctctcgaattttttttcttatggttatgttggtcatcataattcatattttaaatttagaacaatttagtttgaactaattttatcttatgttcaatcacatacacaaactgtttttatacagcttcacccttacaatattgtttttgtcacaaattacatctatatatattgtgtgaccattaatctagatttataattattattatacatttttcttttaaatcatgttaatataagaaatataaagatgagtcacaagccaaatatacaataagactgccttttctatctacctagggagttatcattactagagttttttgtttcttcatatagcttcaaattattgcctatatttttccacttcatgctgaagcctccctttgacatttttggagggcagttctacttattgcaaactccctcagctttcctcagcttttgtttatcagggaatatcttggtttctccttcatttgagtgacgattttgctatatatagaatttttggttgaaagctctgttcttggctgggagcagtggttcacacctgtaatcccagcactttgggaggctgaggtgggaggatcacctgaggccaggagtttgagaccagcctggccaacatggcaaaaccctgtctctgctaaaaatacaaaaaattagctgggtctggtggtgggagcctgtaatccccgctccttgggagcctgaggcaggagaatcacttgaacccaggaggcagaggctgcagtgagctaaggtggcgccattgcactccagcctgggcaacaagagtgaaaccccatctcaaaagaaagaaagaaaggaagctcttttctttaaaaatgttgttccaccttcttcttgtctctatatttattgctgagaaatctcctgttaaacttattgagaatcccttatatatatcaagagggttttctttcgctgcttgcaggatcctatctttgttcttatcttctgcgtattttattataatgtgtctcagaatgcatttttttagtgttttttttttttttttgagtttgttgaacttcttgaacatatagttctatgtcctttgccaaatttggcaagttgttggccgtcatttgtttaaatactctttctgcccttttcctctctctcctcttgtgatttccattattttatgttgctatgtttgatgatgttttaaatgtgtcttaggctttgctcattttccttcactcttttttctttctgctttctgtaccagtaattttaattgatctattattattttcactggttctttcttctgcctgctcaaatctgctgttttattcttctactgagtttgtatgtaagttcttagacttttaagctccagaatttctgtgcatgtatgtgtttaatactttttatctctttattgatattttctacttttttcatacattgttattctggtttcctttagctctttattcatgatttccttcagctctgtgagcatatttaacacaattgatttaaagtcattctctattgagtaaaatgtctgtgcctccccagcagcagtttctattaacatctgtgaatggacttcactttcttatttctttggatgctttacaatttctgattgaaaagtgtacatcttgaatattacagtttggaactcttataatcaaatttttcttccttttctgggtgggcttttgtttcttgctgtaggctgtagctatttgtgttttctttggtagaatattttaaactatttttgaaaaatcactattattcaccatgtatgttctctgaagtctctgttctttaggttgtggttagctagggttttctgtttgattattctgttttccttaatattttggtttagaaatgttttcttgaatattaggaggcaaatgtggctatggtggggtgtggaggctaggagaaataaaaaacagagagggtaaaataccttttcaggttagctctgtgtttcacacttaaacacttagccagcccatttacaactctaccttaatctttacttcctgcctctcttattgtgataaacctggattccttattatagttgaagcccagcataaggtttatatctttaccacctacactgctttctactttattatatgattcataatagtttctattacaaactaagttctcaataaatgcaggcatgcattgtaatattgcaggtttagtttcagaacactgcagttaaacaactattccaataaagcaaatcatacaatttttttttggtttcccactgcatgtaaaagttatgtttatcgtatttgtagtttattaagtgtgcaatcgcattatgtattataaaaatgaacagaccttaaataaaaactgctttattgttaaaaaaattctatttgatgatctgagccttctgcaaatcataatctttttgtcagtagagggtctttccttgatgttgatgactgctaactgaacaagctagtggttgctgaaggtgggtgtggctgtgacagtttcttaaaataagagagaaataaagtttgccacattaactggcaattcctttcacaaaattttatccatagcatgcactgctgtttgagagcattttctccacaatagaccttctttcaaaatgggagtttcttctctcaaatcctacttctttatcaactaagtttatgtaatattcgaaatcctttgttgtcacgtcaacagtgtttacagcatgttagctaggagtagattccatgtcaagaaactgctcctttcacttcatccataagaaaaaactcctcgttcattcaagatttattttgagattgcagcagttcagtttcatcttcatgttccacttttaattcaaattctcttgctgcccctaccacatctgcagttatttcctgcactgaagtcttgaacctctcaaagttatcagtactgattggaatcagcttcttccaaactcctgttaatgttgatattttgaccttttcacataaatcacaaatgttcttaatggcatctagaaatgtgaattatttccagaagatttttaattcactttgcccagacccttcagaagaatcagtatctatggcagccttatcaaatgtaattcttaattaccaacattggaaaatcaaaattactccttgatccgtaggctgcagaatggatgttgtgttagcaggcatgaaaacaaccattaatattgatgtacatcttcatcagggctcttgggtaaccaggtgtattgtcaatgagcagtgatattttaaaaggaatatttttatgagtagtaagtctcagtagtggatttaaaatatttagtaaaccatgctgtatccaagtgttgtcagccaggctttgttgtttcatttataaagcacaagctgagtagctttagcatgattcttaagggccctagggttctgaggatagtaaatgagccttggcttccacagaatgtcaccagctgcattagcccctaataggagagtcagcctctcctttgaagctttgaaaccaggcattgacttttcctctctagctatgaaagtcctagatagatcaagaccatgctggctaacacgatgagaatccatctctactaaaaatacaaaaattaggcaggcagggtgtcacgtgcctatagtcccagctactcgggaggctgaggcaggagaatcacttgaacccaggaggtggaggttgcagtgagctgagatcgcaccattacactccagcctgggtgacagagcgacactccgtctcaaaaaaaggaaagttctagatagtatcttcttacaataaaaagctgttttgtctacattgaaaatctctcgtttagcatagccaccttcatcaacgatcctagctacatcttcttgataactggctgtagtttctacatgagcacttgctgcttcaccttgcactttgatattatggaaatagggtctttccttaaacctcatgaaccaatctctcttagtttcaaagttttcttctgtagccttctcatctctctcagccttcacagaattgaagagagttaggaccttactctagattaggctttggcttaagggaaaggtgtggctagtttgatcttctatccagaacacaaaaactttctttatatcaacaataagcctgttttgtttttctatcatttgtatgttcaatagattagcacttttaatttcccataagaactttttgtggctaactgttgggagcaagaggcttagctttcagcctacctaagcttttgatgtgccttcttcactaagcttaattgtttttagttttggatttaaagtgacagacatttgactcttcctttcgctggaatacttagaggctactgttgccctaatttcaatattgttatgtcttagggaataagggggcctgaagagagagagagagacaggggatcaattggttgatgtcacggttagaacacgcacaacattatgctcttatgtggtcatggttcatggctccccaagacaactacaatagtggcatcaaagatccctgatcacagatcaccgtaacagatataataataataaagtatgaaaaattgtgagaattaccgaagtttgacacagagacatgaagtgactgcatgctatcagaaaaatggtgtcaataggcttgcttgacaacaggctaccacaacccttcaagttgtaaaaaacaatgtctgcaaagtgtaattgagcaaagcacaataaaatgagtatgcttgtattgaccagtgacaaatttatctggttatccactcttgcaataaaaatgtcagagaattgtttagtgaaagttcttgataatgaagtaataaataataatacaatagaataaggttattaaagctgatgatattaccaaatagaaaagaaagtcaacatcttttgagacttgaataatatttattataaccctggcagtttgaaatgtggaaaaacataaacttgtaaaatacacaataaagtacgttcagtagaacttagtgtagtgtactctaacaaagtattgaggacccaaaaatgctttggggcatttgaattgcatatatcaccatttgtaaaattagacattgcaaataaattctgagatttcaaataaaatgtgtattaatttatttaagatgacaataataaaacaattacatataaatataaataacaaaatgaaaagttatgtttttcaaaacaaaaaaagcaaaataaatggtattgtttcacatttttacaaatgtatttaatgtctaactcagaggaagatggcagaattctcatatgtgctcctctgttaattcttttgcaatacattgttttggttgagatatatgcagaaattctgacctgataaagacacatagtcagaaatagaatatgtatgttaatagctatttcagatcattgtagaggttttttgctgttacttcctgaaaactagataagtgctagatgcttgaaggttaattgcagtgtaaaatctgaataatattttaatactctgctacattaaagtccattggtccatcttacatgttgaaagactcttacccacgtctacttctgtaatatgaattggtcatttgtaaaatattagttcattgagttatgcaggtcttccaaatgtcagtggagtttattatacagccatgcacattataatggcttttaggtcaatgacagacttcatatatattggtggtcccatttgattgtaattcagctgtaaagttcttatcccctagtgacacaaccgtagtaaggtcatagtagcatgattcattactctggtgtttttggtgatgctggcataagtaaacctactgtgttgcctgtcctgtaaaattatatcacatagaattacatatggtacataataataatgataatagactactacattactggattatgtatttaatatactacacttttattattttacagtgcattccttctacctattaaaacataagttaactgtataatagcctcacgaatgttcttcaggaggtattccagaagaaggcatggttatcataggagattttagccccatgcaccttatttaccctgaagaccttctagtggaataggatatgaaggtggaagacagtgatattgatgatactgaccctgtgtaggcctaggctaatatgtgtgtgtttatgtctttgttttttaaaaataaaaatattaaaatagacaaaggttatgcaataaggacataaagaaggaaaatatttgtgttcagttgtcaaatgtgtttttaagctaagtgttattagaaaagtgtcaatgatgaaaaacattgataaagtaaagcagttacaggaagctaaggttaatctactactaaagaaagaaaattttttaatgcatttaatgtagactgtgcagtgcttataaagtctacagtagtgtgcagtaatatcttaggcattcatattcactcaccactcacttactgactcactcagagtaacttccaatcctacaagctccattcttgaagtgccctatccaggtgtaccattctttttatcatttataatgttttttaactatatattttctatgtttagatacacaaatagttaccattatgtttcaattgcctgtgattttcagtgcactaacaggcagtacaggtttgcagcctagcagtaataggctgtatcttatagcatagatatgcagtagactttagcatctgggtttgtgtaagtacattctacgatgtctgcacaaccatgaagttgcctaatagcacattcctcagaacatatccctgtcatttagtgacatgtgattgtacagttgttaaaaatcatgatgaatttcactaatgatttcactaggaaaagctcactagagaattattgagaaatgatcaaacttaagatggagaatatcagttttctaaaattcattttcttgcttgaaggggctcgaatttttttgtttgtaacaaatacagccaattgtggattttgtgaagaaaaagtttacttcattttgaagaaaaacacctgtcagacacttaaatctgaataattgtagtttgttactcattccttccagtaaaaataatgttctatgagaaacaatgtggtgagtttagctcataactcaagcaactgaccatatgcttttccatgagataaccatcatatttcgtatgcactggtgttattttattttttgacatactgcaccacacagatattcaaaagatgttgagagtcaagatgtagtacaattaatattttttactacttctgaactgaaactgggtttatttttaaattgaggctatatggccataaagaatataatgacaattgtttgatgtcacagtgtcgacttatgaaagggtgcctggagttttatcaaccattgcttttgtatcacaagtgaaaatttcaacccattgacaaggacaataatgtcttcgtgttattatgaatacagttttgatttctgtgacccctgtcttcctgaagtccacaaccatacaccagaaacctctggtgtaggctaataaagacatgcaataaaaatttggtcatggtaatgtgatagaatcaagcaacatatgtgaaggaggaacttaaatatgactttatagagccataacactttagggtaaaaggaggacatcatttcagggtgtatgtgtgtacacatgtgtatgtatcacagtgtgtaaatgctcttctccaaatgtggaaagcttacatacatttctcatatttagattctttactcatattcaggagatgttaatttgaaaaaggtctcagaaagaggtttgagaatcattagcattttgaatgattgactaatttggctaattagaactatgagtaaatcctaaagctcttgacttatgtaatcaatggatgataagtttgaggtaaaatttaataatagtccttcagaacctaaaggtacatttcttatttgatgagcactttgagtcactgccaaaaatgaaagagcctagtataagatataccagaaatttgagaatcctaagagatgcaagctagtttgcagctcatcatgtgtgtttgtatgggttttgtgtgtgtgcaagcatgtatgtgtagagcttcaaataaaattctatacaaagaatcaaacatgccaaagcagcatttttctggttgaagaggtctaatcacataacctctgtccttccctcatctcttctctatcctgaaagagttcactagagtccttagaacactgctggatatagtgtgatttagtccaactcttggtctttgcaaatgcaaaaaatgatgcataaataaatggagtgatctaaccaaagagatacctgctagtgaagggttgaattaggactaaaatatgaccttctaactctgatcactgtttgtgaagcatcattgcccatccccttttgagaacagagaagcagaggttagatttattacagtatgctgggcactgcagggaaggtgaaggcattgtaggtggtaaacttcttgcagattatgcttttgttttatgtactcagtatgaatatcctaaatattatttctatatttgttgaaaaaagagcagagttttgtgagaaaacagaaagaagcagataataaattatatttcatttgtcagctgtcctcctcattctatttaatacaggcacagtttggtcttaatttagttacttaccctatgttgagttttaaaaatgtatttataattaaaatatggctttctgtatgaaagtcccattttggaaatatactcagataggaaagaacattcattggatgattgtctgacccaggaaacaaattaaattaaggagtatgtattattaggctttgtaagatacagggataatctgagtcaaaagtagttcttgctttctttattttttattttatttaagttctagggtacatgtgcaaaacgtgcgggtttgttacatatgtatacatgtgccatgttggtgtgctgcacccattaactcatcatttacattaggtatatctcctaatgctatccctccccgctccccctacccaatgacaggccctggtgtgtgatgttccccttcctgtgtccaagcgttttcattgttcaattcccacctatgagtgagaacatgaggtgtttggttttttgtctttgcgacagtttgctgagaatgatggtttccagcttcttccatgtccctacaaaggatatgaactcatccttttttatggctgcatagtattccatggtgtatatgtaccacattttcttaatccagtctatcattgatggacatttgggttggttccaagtctttgctattgtgaatagtgctgcagtaaacatatgtgtgcattgtgtctttatagcagcatgatttataatcctttgggtatgtacccagtaatgggatcactgggtcaaatggtatttctagttctagatccttgaggaatcgccacactgtctgccataatggttgaactagtttgcagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcttttgcccactttttgttgggtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattgtggcttttgttgccattgcttttggtgttttagacatgaagtccttgcccatgcctatgtactgaatggtattgcctaggttttcttctagggtttttatggttttaactctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtactatttctgttctgttccattggtctatatctctgttttggtacgagtaccatgctgttttggttactgtagccttgtagtatagtttgaagtctggtagcatgatgcctccagctttgttcttttggcttaggattgtcttggcaatgtgggctcttttttggttccatatgaactttaaggtagttttttccaattctgtgaagaaagtcattggtaacttgatggggatggcattgaatctataaattaccttgggcagtatggccattttcacgatattgattcttcctatccatgggcatggaacgttcttccatttttttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttatttgtgtataagaatgcttgtgatttttgcacactgattttatatcctgagattttgctgaagttgcttatcagcttaaggagattttgggctgagacgatggggttttctaaatatacaatgatgtcatctgcaaacaaggacaatttgacttcctcttttcctaactgaataccctttatttcttcctcctgcctgattgccctggccagaacttccagcactatgttgaataggagtggtgaaagggggcatccccgtcttgtgccagttttcaaagggaatgctcccagtttttgcccattcagtatgatattggctgtgggtttgtcatagatagctcttattattttgagatatgtcccatcaataccgaatttattgagagtttttagcctgaagtgctgttgaattttgtcaaaggccttttctgcatctattgagataatcatatggtttttgtctttggttctatttatatgatggattatgtttgttgatttgcatatgttgaaccagtcttgcatcctagggatgaagcccacttgatcatggtggataagctttttgatgtgctgctggattcggtttgccagtattttattgaggatttttgcatcaatgttcatcagggatattggtctaaaattctcttttttttgttgtgtctctgccaggctttggtatcaggatgatgctggcctcataaagtgagttagggaggattctctctttttctgttgattggaatagtttcagagggaatggtaccagcttctccttgtacgtctggtagaattcagctgtgaatccatctggtcctggactttttttggttggtaagctattgattattgcctcaatttcagagcctcttattggtctattcagagattcaacttcttcctggtttagtcttgggagggtgtgtgtgtccaggaatttatccatttcttctagattttctagtttatttgcatagaggtgtttatagtattctctgatggtagtttgtatttctgtgggatcagtggtaatatcccctttatcattttttattgtgcgtattttattcttctctctttacttctttattagttttgctagtggtctatcaattttgttgatcttttcgaaaaaccagctcctggattcattgactttttgaagggttttttatatctctgtctccttcagttctgctctgatcttagttatttcttgccgtctgctagcttttgaatgtgtttgcttttgcttctctagttcttttaattgtgttgttagggtgtctattttagatctttccttctttctcttgtgggcatttagtgctatgaatttcccgctacacactgctttaaatgtgtcccagagattctggtatgttgtgtgtttgttctcattggtttcaaagaacatctttatttctgccttcattttgttatgtacccagtagtcattcaggagcaggttgttcagtttccatgtagttgagcagttttgagtgagtttcttaatcctgagttccagtttgattgcgctgtggtctgagagacagttttttataatttctgttcttttacatttgctgaggagagcattccttccaagtatgtggtcaattttggaatcggtgtggtgtggtgctgaaaaaatgtatattctgttgatttgggtggagagttctgtagatgtctattaggtccacttggtgcagtgctgcgttcaattcctggatgtcctttttaactttctgtctcgttgatctgcctaatgttgacagtggggtgttaaagtttcccattaatattgtgtgggagtctaagtctctttgtagatctctaaggacttgctttatgaatctgggtgctcgtgtattgggtgcatatatatttaggattgttagcttttcttgttgaattgatccctttaccattacgtaatggccttctttgtctcttttgatctttgttggtttaaagtctgttttatcagacactaggattacaacccctgcctgtttttgttttccatttgcttggtagatcttcctccatcccttcattttgagcctatgtgtgtctctgcatgtgagatgcgtctcctgaatacagtacactgatgtgtcttgtctctttatccaatttgccagtctgtgtcttttaattggagcatttggcccatttacatttaaggttaatattgttatgtgtgaatttgatcctgtcagtatgatgttagctggttattttgctcgttagttgatgcagtgtcttcctagcatcaatggtctttacaatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttggtttggctggatataaaattctgggttgaaaattcttttctttaggaatgttgaatattggcccccactctcttctggcttatagggtttctgccgagagatccgctgttagtctgatgggcttccctttgtggataacccgacctttctctctggctgcccttaacattttttccttcacttcaactttggtgtatctgacaattatgtgtcttagagttgctcttctcaaggtgagaagagaagtttagggaaaaaaagagtaaaaagaaacaaagaaagcctccaagaaatatgggactatgtgaaaagatcaaatctacctctgattggtgtacttgaaagtgacggggcgaatggaaccaagttggaaaacactctgcaggatattatccgggagaacttccccaacctagcaaggcaggctaacattcaaattcaggaaatacagagaatgccacacagatactcctcaggaagagcaactccaaaagtaattctaattagtagaatttatcaggaatggaccagagcagactctgttttttttttttttttaagaaacctagctatttctgcaacaagagattagaaagagtaagaaaaggcaaaagaaagatatatagaaggaaatccctagtatgccaagaagagcaaaggtgattccctggaactgtaaaacagatgtagtgtatttgacttttcctttttggcttttgcttgaatggatgaattaggcttcacaatactaagtgacaagctattaggttttcttcattaaagagcttgaactatagattattatttttccaatttatattttggaacttataaagtcaacatagttaaatacacttctgaaaagagacttttctgtgaattttacattttactatatttttccaataactataaagaagcaacttcatattgtgtttctaaaagtaaatctgagaatacacgtagaaacatttcggttgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaaaataagaatagaatttatatttcatatgttaagtactaaaacaaaatcttaggatctgctgacaagttagagaatgcacaaagcaatggcagatattttgaaaaatctagaatttaatcttgactattgtgatttgcattctgtagtttcatctagctgtgcaaggaggggtagaagtgatgttatttcaatcagctagtcaataatatttaaaatggaaatgcattagaagactatcccatatgacactaaccatggaaaatgaagaatacgattaagagtaaatatttaaactacagccctgggaatggagatggtggtactgggaaaacccagctaagggagaatcacgtgagtagaaaggaaaatagcttgttcttcttgtgggaaattttaaataactacttgattagatttttctttctatttctgttttaataggaaattattttgaataggatttaaattaaggaaatatttctaaacctctgatatcaagaataaactagataaaactaacacaattattttcagcaaagaggaaccaagaacttaaagtcataaattagcttttcttcagttgaatgctgaagaactttctttttttttcatctaagattatgcagccaactcatttcaaaggccatttaaaagcaagattggatttttggaagaaagaacagaaatacccatagcagtctatgatcttaaaggaccaaatagagcacagaaaagaacatggcgtgaattattcaatttcagttctgttgccacattcatattgtcaaagctgaactttttacttaagattctacaataccttgtaactatttaaccaataaggattctgtttccaggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggagaacaacctatgagaggtgaatattaaattttagcaatattttctttacattagggactaagtattgattttagaatttctttctctaaagattaataaaaattaataatattttgaaagagtgtctcaaaatgatttacaatctaatatttttttctgagccaccttctcgttgttcagtgtgagtgattgagatgaatgattgatatccaggtttctctgtttgctaggtaaaaataaagagaaaattatttaaatgtatcaaatagtaagatttctctaggtgattctccctgggtctgattctaacataaattaagttcctgctaaattacgttgcaatgtgagtaataaatgtttgttgatgactgagttccgttgtaactataaattgcctgtaacaatgagcagagggtaagcttggaatttaagacatattgtagacaagtgtcttgaagaaagcaaaaaaaaaaaaaaaattcctacattttagtgaatgctgtgacatttctctctttgagaaaagaggatatgctattatcttcctgggcaagttgaggcagaatgggatgctaataagctccagaggggcttacactaaggagttggatttcagttggaagaagggttctagtggctaaaaggcaataagaatattcctaaaatatttttgtaagattgtatattgtcttgtgaaaagatgctattaatacattattaaagagaaaaggaaagaaaacttatttttgggagatagtatagcttaatgaagaaaacctaaagtcagagagatgcaggttcaagtttcagctctgccaattactagttacgtggtctttgtcaacattgccgagcctgtttctctgtgaaatgaggatactaatacccagtagggtttgggggacattcagaaaagagaggattggttgcaaggaatgaacatcccgaaggattacaatgagacagggggaggctgctcataaaaaaaaaaaaaaaaaaaaaaaaaagatagaggatagaagttagccttggaggctattaaaagagaagcttaattattcattatgtgtataaggaaggagtctttattctaggaatgaaaaattcaagagacctcagggtaggcagctaaggaaaatttaaggaaaggaacaaagaaagcaacacagaagaagaaaaaaacaaagaaatgaatgaagtatatagttttctcagtattgaataaagccaaatacattaattattaaattacataatatctccttctcattattgtttaaacagaagatttatttatagttatttgaattgctttgaagggttggttttagaataagttccaggggcaattggagttaaaaaatattattaaaattattaaactattccagagcacagaaaataaacacaacttcaaaaatattgaataaatgtattaatgtgccaagtgatcaatataatacagaatggaaaacaaaggactgtgtaactttgtctgttaacctagatgtaaacatttaaataaaagtttaacatattaatctaatagtataaaaataagaattcaacgtgcttggttggattttgttacagacatatcgggtggttgtaaacaggagattgtatttatgtaatttttatatcaatgtgttaaaggagaaaaatatgtttatataaaagagtctggaaagaaataatgattatttcataatggaaaaaaagcaatgtcactgacactatgatcattcaacatttttttaaaataaattaattttttttagttttagggattaggcctcactctcttgcccaggctggagtgaagtggcgcagtggcacagtcatagctcactctaaccttgaactaactcctcaactcaaatgatcctcctgcctcagcctcccaagcagctgggattatagacatgagccaccttgcccagctcagtatcatttttcacattcaagctaatgaaataattcaatagaattaaacaaatgcttttcaaaaatgaagttggaacaattagtcatccatagacacaaaacaaaataaaccagcagacaaacaaaacttcatattaagcctcatgccatgtgtgaagatatacaaaaagtaactcaaaatagagcagggaggaatatgtgaaataaaactataacattttttaggaaaaagccataggagaaagtttcaagaccaagaaataggtgaaacattgttagacttgacagcaaaagcacgattcataaaaggaaaaattgattacctggatctcataaatattgatacctttttctccacaaaacattttctaaagagggtgaaaagacaacttacagactggagggaaatatttgaaattcacgtatctgacaaagcatttgtatttagaatagacgaagaactcatcaaatgcagcattaaacaaacacaccaacgaaataattcagttagaaagtgggcgaatgacatgaacagatatttcactgaagactatatgggaatcataaataagcacattaaatgatgttcaacctcattagctactagagaaatgcaaattaaaccacaaggggatatcactacacgtatataagaatagccatttttttttaatgacatcaaatgctgccgaagatgcagagaaactggatcatttatacattgctggtgagaatgtaaaatggtaaaactactgtaaaaaagcatatggaatttttaaataaaactgtaatgtgtttacatttgacccagcaactgcatatttgggcatttatcttggagaaaagaaaatgtatgtttgtacaaaaatctataaaaaaatgtttatagtaactttatttttaatatccccaaaccagaaataacaataactcaaatgttcttcaatgagtgaagagttaaagaatggtctctcaataccctggaatattactcagccatcaaaagtgatagattatttatacattcaacaacttgaatggatctcaagggaattattctgagtgataaaagccagtccaaaagcttaggtatggtatgattgtgattatatagcattcttaaaattacaaaattttaaaaatggagaacagagtagtggttggttgccaagggattgggtgggggactgttaatgaaagagtggcagaagagatcctagtgatggaactgttcttgactgtggtgctggtcacctgtgatgcagttgcgtagaactaaacacgcaagaatgcacgtgaataaatgaatacatgtaaaactgcagaaatctgagtaaggttgatggagtatatcaatgtcagtttcttttcgtgatattattatgcaggatgttacttgtcattgagagaaactgaatgaagagtacacagactttctctgtaatatttcttgcaacttcatatgaatcttcaattacctgggaagcaaatgcatacatagtataattagttgcttaaaatttggaaaagaaagaaaaaagtaatatgtttacagatgctataatttaatatgtagaaaataaaaactcataattgaaatgtttaagaaaatgtgatatggtgtaatcattaatcttataggtataaaaataatttagaatgggaatgggaaatattctgttcacaataccaaactatatatactttgcactaaattcaattggaagggcaaaggacttatataaaaaatcaaagataaaatagtattaatgtacataaaatgaggatggaatatttctgaatgaaaagccttaatattgtgaaatgtttaaaattttccagttttcactgttgtgtgtatgtatattatatatagtgttattttaataaaatttctatttgagttgtaatatgattttaaagctcacatgaaagataccatgtttgaaaattaccaaattattattttaaaatttatttgaaaataagattatttggtgtggtggacttacagccttttttttaagttaacatcttcctaaaaaatgtaaatgaaatatgtggaactcattaggaacaaactaaatgtttttggaagacaaacagatgcatgcatataaaagaaatttatatatataatacagttaattttttaaatttaatagataaggatcatttaagtttgttagcataatttctctcactgaaataagtacatgcctacctcccacctttacctatgtaaatttattgtatcaaataagtcaatgtttatcaaatatagatgataaaatataattctctaaaaattgaagggatctgattagacaaaataatggtaaatttacgtgatagggaaatttaaaaattttgaaacttatctatatcaaacttttgttttattgagatacctcatagaataaatatatttctgaaaccctaataaaattagctcatctgattaaaatcccatacttttatgatggaagctgaattctggaattaagatattttttcgcttgtgaaacaaaaagcacttatccttttatcgcaaatgttcttcctccttctcctgcccctagtattcccttcctctgccttttgaaacatgtaatacccagggtttttttaatagtttttttttataatagattatttttcagagaaattttatattcacagcaaaattgagtgaaaggtacaggaatttcccatattctcttccccctgacccccctgtgcctgatacagaccatgcatagcttccccaattatcaacatcccgcaccagagtggcacaattgctatcactcatgaacctatattgacacatcattgtcacccaaggtctgtttggattcactttccagtggattgtgttgtatgggtttggacaagtaaataaagacatgtatccaccattgtagaatcatatggaataacttcaccaccctacaaattctctatgttcacctgctcattccttccctcgcaattcctagcaaccactgctatttttactgtctctatagttttgctttttcaaaatgtcatgtagttgagattatatactatgtagccttttcttactggcttctttcacttcataatatgcatttaagtttcctccatatcttttcatggcttgatagctcattttttttagcacagaataataactcattaaaaaaatgtatctatttagccattcacctattgaaggacatcttggttgcttccaaattttggcaattattaataaagctgctataaatgtttgtgtgtaggtttttctgtgttaatatgttttcacctccttttgggtaaatacaaaggagcctgattactggattgtatgataataatttgtttagttttataagaaaatgccagattattttccaaagtgactgtaccattttgcattcttacccaggaattagtgagagttggtcattttatgtttaagtgaggccttctctgattttttctgtgagacatttcctttcttcaaactcattaagcactctctatccttatactgacatctattatgtatgtatgtgtgtgtgtgtgtaatttgttttttgagacaaggtctcaccctgtcacccaggctggagtatagtggtgcagtggtgcgatctcagctcactgcagcctccgcctcctgtgttcaagcagttctcccacctcagcctcgcaagtagctgggacctcagacatgcaccaccactctaggctcattttttgttttatatattttggttgacacggagtttcaccatgttggctaggctggcctggagctcctgtcctcaagtgatccacccgccttggcctcgcaaagtgctgggattacaggcatgccccactgcgcctggcctgacatctattatatgttttgttaagcatgtgcaaacccctcagggcaggacagagatatgtctcctatcctttacagtactgcacttgttgccttgaaattttttaatgaaactagaaaatttgtgaatgaattaagaaattctggtgtgtcagactgccaggcaaatgatcaaatatatatcatcacctaacagcatttcgttttgcaaagctctatacaattacaatgtcttatgctaaaattataatcaaacaatactcactatttttactataattttttttccattttttcttggcagttattttatgggttaaatgcatgattgatttatgtgaaagggaattgcatttgacgttattgactctttgccccagccttttcagctagaaaaaagcaaagctcttgctgtaacaagtgctgaaccttttcagaataaaatctaatgaggttagtatatatccttgacattttattttcaaccgaagtgaaggtcatagctgaaaggtcacaaagatgaatttatacagcaaataaacaatgttattattttgcaaagaaaatgcaatattcctgtctttagcctcttgcatgtaaaagggtgtttgtaatgctgattttagtattcaagtcctgttatcttttcatttcttatattttggaatgtagaaagaggaatacacctagcttatctataaaagactagtatgaaatgtgtgtattatcattaatattctagtattttattatttgaactttacatttaagtcaaatctactttgtatttgttgggtactaatttttttggtggaagtaggtaattactctatttccttggtaaacttctttctgacttgagagtttagtcatacataagtccctcaagtctaccatctttggtttttaacaacaaaactgtacatttccaatgaaagaatatatcaacataagtttggaaaataaggggctgaattatagttaaatggtagaaaatctgcctttttgggcacaatgtacaacaggaattcttaactgctttcatattatattactaatacgtaacatgggattgctctattaaatttgtaccagatcaagacaattttaatagtaaaaatagtttcatttatttaaaaagtcattaaacaaagttcaaatgccaaaaaccatgtcaaaatggtcactttatattgttatgtagttaatatattttagagcaaatattccaaattttgtaatttgctccttttaaaaaacaagcataagataggcatctaacctagaatttcctttattttagatgaactcacaaattcgtcagaaaccagattgtctttggaagacctctttaggaaagactttgtgcttcacgatccagaggctcggtggatcaatggtaagtgtatacctttttaaacattgtattcattttgagttctgtataattaaaattttaaaaaatgagatgtgtaagctgggcgcaatggcttatgcctgtcatcccagcaccttgggaggccaaggcaggagaatcgcttgaacctgggaggcggacgtcgcagtgagccgagatcgcaccactgcactccaacctgggtgacagagcgagactccatctcaaaaaaaaaaaaaaaaaaaaaagatatgtgtagttaatatttaattgaaagtgtacttcaaagattacatgggtattatttaaattaaaaccttggttcttgtgagagaaaatcaattcctaagatagggcgtcaataaattatttggcaaacattgggttgacagttttgtatctgctgctctctcatgatcattagttacatgactttaaggatgtattacatctctagcacatcactagataatttttcttagtttggcagtgtacattttgggagctagtacgtagaaatgttaagtgcttcagatttgacaatatgattggtttttgttattctctgtggcttttctttttaagcttaagtgttacaagctagtgagactctatgcaaaattgaaatgacttggaaatatatggcactttgttgtttttttttctggcctggcaaataggactccttaggttctcttaagtcaatctctgacataaaaataagaaaataaaaccactgagtggcttcataggttttgctttgtctttatggaagatcataagggcataatgtgttggtgaaaaggaaatcagttttttaatcctttgaatgttctaatttgaccaaccatacgaatcattatggttggatagctgttaatctttacccttcactttatttgggcataatatctttgctaattttcaaggcatagagtgtattatttgtataatagatgaaaggagctttgccttttcatataataaagatcatcatacttacagtccattccttcctctctcttactctacttaagtgtatttatgctggtgaattaaactttaatttatggaagctatataaagagaatgtaatttaacccatgagggcaaaggccaaatcacgtgtgtttacttgacactgatatgtctcctggagatctgcaggcactcgagattggttttttgaataaatgaatgaatgattttaattgatgtgcagtctcattttcacataaacttaaattttaattgaaatcaattggaagataagtgtgtattgtgatgatattacggataaagaacacaaggtagcgtttttcttaatgaatctgtatatttttattttgaattgtttataaatttgaggctagtcatatttttgcctttgtactgtgattatttcacatatacactataatgagtgctatgactaaagaaggctaataaaaaagatatattatcacaaaaaattgtccaaatacacaaatctctcataaataattcttctaatgtgtgattataattatgacaatcacctgtttactctttagcaaatattttctattgagagaaatgacaaaatgaaagttgctaggtttttttaaacagtagtattatgagttgttagatttgaaatgctgaataatcttgttttattcaccatgtttttggacaaattatagacattttgtagtctttgactttggaaaacatgaaaaattatgggtctcatctcccttctcaggttagcttggactatttagaggcatttactcctgtgtataactgactctgtgatattgaagctccgaaggacaggacagatatttaagtagtgaactgcatgctaaattaaaacatatttcaatatgtaggacacagattctactcttatacttcataggttaccaaaataatatatttggagtttatcatttttcaagtaatttctttattaatcattggttaaatttgatcctaagaaggcatctgggacaaagctgcagtgttattataatgttctaagtaatacctaaatatataatttttataaagaatttgacataaagacaactctttaaattggaataaacagaacctaagctctgaaagaatgcagtctttataaataccattgaaggaactgtctcaatgcctgtaaattgtgtgcactgagttactttttaagtatagaaatggatttgtgcttttatccaacccagatctttctggcaagtgctagatacttggcctatttacgtattcctcacatagcctggaaattcaatgggaaatatatgagtaggatgtgtaaccttggcctcattatcaacagttatatctaaatgtaacctgtgagctttttctttattctcaagtgatatctcaacaggttttctttgtacataagtcacttgaaggagttcgagctcagcttatttggaagcatcatttaattcttggaggtcatcatagaagtgcttaatgcattattggtcaaggggaaggagggagtctagacggccctgacatgtgtaggttatagtgaggcgatgccattcattatgcttggtctcaaaaaatatgtctgagaatatcattgcagtcttggatgggtgcccctgttcatggttagcttaacaacggccttaccccaagtctgctcatatctttgaaatctacatttttatagcatcttcattctagcaatgtcaccttgaaatttgaaaacccatcttatttaaaattattcattctatccacacacatttgataatcaattaatcaccaaagaaagatctaacattgagtgccttctattgagactctgtgatcgatgctttatgtacatatttcacaggactgcatatgacattaaagttaaccccagaaaactgaggcttaactcagaaacttatccgaacacacacctaataaaaggcagaggctgctttactcattatgcttaagtataaaacttgacctctttcattgtttgactctgatgtgtcatcctcatatctaacatatttatcaagcacctcactgacaatctcattttaacagacctcattgctgtcgtagggtggaaaggtatgaaagccttcctcacccatcataaaggtcacagccaacactgctgtaacaaaagaccagttaaaaagagaaaagcataacaaatttatttaatgaaagttttatgtcacttggaagactttagaaatgaagaatcaaaggcctagggaaaactgtccatttgtatgcttaggttaaataaagtacggacagtgtattgaagtgtgactggacaaaaagggtatactctaatgataataaaatgagggagaaacccagcaaagcttacctgttcagatccttcttggcctccctgtgtagcatttcatcctgccagatataaggcagaactcccccggaaatagggtcttatgatctattatctgaaaggtaggtcagtgcatttccttgtgacagctcctacacagaaaagcagaggaaggttaaaatatttttaaatcttatggtttgcttggaaagagggatgctagtttcttttattattgttattatactttaagttctagggtacaagtgcagaacatgcaggtttgttacataggtatacatgtgccatggtggtttgctgcacccatcgtcccatcatctacattaggcatttcccctaatgctatccctcccctagtcccctaccccctgacaggccctggtgtgtgatattcccctccctgtgtctatgtgttctcattgtgcaactcccacttatgagtgagaacgtgctttgtttgtttttctgtccttgcgatagtttgctgagaatgatggtttccagcatcatccatgtccctgcaaaggacatgaactcatccttttttgtggctgcatagtattccatggtatatatgtgccacattttctttatccagtctactattgatgggcatttgggttggttccaagtctttgctattgtgagtagtgctgcaataaatatacatatgcatgtgtctttatagtaaaatgatttgggagtaatgggatttcaagtttttgtaacctttcctggggtagaggaatctggtttctattacttgcttcagggatggcagagaggtaggagacaggaaggcagaaggaggtcagatacagactttgcttctgagactgctcagaggccttccaatatcttagtcagttcaacgtactcagcatgccaccatgccatacttggaggtatcattttctgagtcccaacactattaattttttcatgttgaatactacaataatatgtttatttccccaggtacattcatgtagtggtaacttatacagtcactaaaactagagtttatacacatgtttattgacttgatcatgatctagaaaagtgaacaaagtaacttcaaaacagcattgatagtatgtgatatcacattgtctattgtgtaacagtgattgtctccagattatccctttctttttacttattttgttttttctcgatttttttcaataaatgcatgtgtttacatagtttttttttataattttaactttttattttagatttagggagtgcatgtgcaggtttgttacatgggtatcctgcaacgttagcactctcaggatattcattttgagctattagataaaatcaatcaagtgctattttatttttaaactttgttttccactgtgtcagaagacaattccaaaatttatctgatggagtataaacaattaaaattatcatttgataaaaaaaagttgtaaattttaaatacatttgggttccagtggacaaacataccatcatgtaatgagattttaccgtgcagctagtgtgtcctttactcaccccatgagtttgacaacacctgctcagtgatattggtccacttaccatttgttatgaacctgcagcaatatcaaattgctatgaaaatttttaaatgtgtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaaaaaaagaaaagaaaaaaactataaatgaaaagtcaaggtctgtagccttgtggatcttcaaatggtagcgattcatagaactgatgttagagatgctctgaacacctgacatttgttaataaatgcgctgggaggtctcattctcataatatatgcaggatattgaagaggcagtgaaaagtcactattgtagcctgtatgaaaaacaagaaacattattgtaatatatcaataatatttacagtaattaggggaactgtaaataggaaaactaaacaaatacatctttgttgtttcttgcttgtttgtttgacactaatttgtcatactagaattattgtccatcaacttcacttggtagagctgcagaagttgttgtgtttctcagtgcacagggagctacttctaactccaaagacatcattaccctccctttagcctatattcagcccccagtcaaaattatcttatgtttatcttattttgtatcttcgtgaccaaagtgttattttttataatcatcaaccaaactgatagttaaataaaatagagttgaatttatattcatgaggctcttgaagataacacgtatttttcttgcaacataatttataaagataaaaccttgcatagattctagatgcacacaattaggtatatggtcaaataaatcaatttgcatctttttaatggaaaactaaacagctgtaaaaattaatatttaaaatattagtgacattgaaatatgtgcagataatatattaattgaaaatagcacaatatggaattatatatatagtgtattcacaattgcattacttgcatatacacacaagtatatgcaaagaaaataatacctgaattcaatatgccaaaatattaaataattttctgttagagtgattgagttgtttttattttttccctttctgtctatattttccaaattttcaacaggcattctgctgtttcctactatggcaattttatgtactaactacggatattcaaacttttgtttgaaattcaaacctaacaagtaaatggttactaaaattctcattatggtagatgcattcagctagacaaatattaattttgttattctgcctgtgccttttttctcagagatctgtatgaaaaggaggtacagagaggagcgtgaggttactgaacctgggagaatgagaatgttcttagcacagcaatgactattagacttaagaggcatggattcttataacagcagtttcacttccttctttcccaatagattgagacataatatttcctgtagtttattatgttcttttttcttccactaatccaaacctctgcaacatgcaatttatctatattacaaacctaaatagtaccctagcccccaaagggtttttttaaaaagtcaaaaataacaaatgttgatgaggctgtggagaaaagagaatgcctatatggtgttgctggaaatgtaaattagttcagccactatggaaggcagtttgaagatttctcaaagaacttacagcagaactagcattggactagcaatcttattaatgggtatatacccaaaggaaaataaactttctaccaaaaagacccatacatttgcatgttctttgcagcactattcataatagcaaagacctgaaatcaacctaggtgccccaaaatgtaggagcggataaagaaaatgtggtacatatacaccatggaatactgtgcagccataaaaatgaacaaaagcatgtattttgcagcaacatggatgcagcaggaagccattatcctgagtgaattaatgcagaaacagaaagctaaatatcacacattctcacttataagtgggagctaaatcttgaggatgggcagacgtaacgataggaacaacaggcattagtgactccaaaggtggggagcggaggaggggaacaaagcctgaaaaacttccttttgggtactacgttcactatctgggtaactgggatcaatgaagtccaaatctcagtatcatacactataccttgtaacaaatccacacatatacccccaaatctaaaataaagattaaaattttaaaaatcaaataaaaagtaaaaacacataggaggctattgaaataatgacatacctagttcctgattcacagaccagagacttgtaaatgaaatttggaatgtaaatcatggttatcaaggctgacttttcttttcagagttatatatgacaaagtatcttcctatcaagagtagataatttcctactaaaactaaacaaatgcttaaaaagcataccatgaagcatatttacttctctccaaatgaccaaaaatgttttatttattgctatgttgtttgtaaaattgtgcttttaccaaagtttagattaaatttcatctgtattaaaactgtttgaaatcaataaaatggaaatatctactataaaaaatcatactgtggcaatcttacatactaactacgatattcaaacttttgtttggaatttaaatctaaatagttttcttcaagaaaatatttttaagatttcagtttgtctaaaaatgacaatacttaaactaaacaccaagagagagaaaagggatttactgataaaattcagtgttaacatttaggaacaaaaaagtatgtaagaaaaaaatatatttctatcacctaggtatgcaatgatcaaagtatttaaagagaatttgaaacacaaactaaactttagaataaagaagctaaatatttatgttaccacttatttcttgaaatataaaactatattttgatttttaaaataagaaaaaaaagcttggggaaatgggatgaaagttatgttcagagttcatcaacaagcatttattgagcttcatatatgtgctctgcacagagcttcatatattccagatggaatctgtttacatttgaaaagtttgtagtaaaatatctggtgtcctcatagtcctttgatattctatacaattgttggtcttggccttgatggcccaggaaatctgtttgtcaatacaaatatagaataatagatacattgacattgacatctatctttccatctatatatccatctatccttttatctatccaacatgtattgaaaagattgaagcacagccaaacatttttctagatacaaagatataaaggtgaataaacacagtccctttgatcaacgacattatgaatataaagggtttttttcctcattgagcacaaatctttccagttgtctcaggcttaaaagtaaaattgtaatcaaaaggctgtgaatgggacagaaagtagacataactgaagagttgcaagaaatactcagtccaattacgatgaagttttattaaccttctccaaaatcaaaaacacatcttcacatcctacatctctctctttactatgatgcagggtacacatggcacattttatttttttgagctgctgtgtacgccctgcctctctttttatttgatacagtcttcacttacatatggtaatgatcatgactaatatatacatgtaccactgacatgttcaaaaaaaaaatataattatggtacccagagactatagaaactagatcaaaataataggcctaaaacaattaggtgaacaataattaggtgatccatttctgggtaattattttttaaaaacagatgttgcaactaggagaaatcggtttgagttaagaacggttggagtcgtctttatggaaaagataaaattcagtcgcagtctagagggcagatgagcccaggggatgaatgaagatattgttgggagaacaaggatgtgttatgacaaaatcacagaaattagcatggtgtgtaagtttaacggtaaggaaaatgctgtgtatgtgtgttcggggcctctctatgtataaaagtaatggaaaataaagttgagtaactcagtattggcatatgattagaatatgtatatttgatcattttactgtaattgttatactttgatctcctttagcagattaaccctttattagctcttaatttgaaacagaagaatttaaaattgctctgataaatgtcagctattttgtgggaatgggagttgttagtagtaggaattgaagtgggagatattagtaataggaatttacctaatacgtgttcagtaagtcaaaatttgcatgtatgtttctacttttctaggacacttctacatatgctatttatttgcatttttttgaaaacccttcttagggaggcaggatgggcattatttttgttttatacatgagtaacttgagaagcaggttttttccacttctctcagattcactcagtaataagttctggctagaagccacatctttcatgtttaatgtttggtggaaactagagtagagaaaacgtttcaagtgaattttttttattatcatgaaactaacatttgacagtgtttataaattaatttttaaaacacatagatttaaggaaaacaatattaaaggaaaagtagataagaataaggaaagattttctttgtaattgtatatgaatgtttccattttattggaatgtttagatatttttagaaaatgtaattgttcttatatgattgattttacatgtaaaaaaagaagtcattgcagataatcataataagaaactgaaacttaggacatattttcattttttaaaaaaatgtattctttcttgtcaacttttattttagattcaggggtacatgttgttacctgggtataccaggttgttacctgggtgtgttgtatgatgctgaattttgctgtatgattgaatatgtcacccaggtaatgagcatagtacccaacagatagtttttcaaagtttgtctcccacattccctccctaccccctcttattttcaccagtgtctaacattcccatctttatgtctatgggtacccaatgtttagttcccactttgcttgtggtatttggttttttgttttggtttttagttttagtttttttgtttctgcattaattagcataggataatgtctcaaaatgcatctatgttgttgtaaaatgacataatttggcctttttatggctgcatagtattccatggtatgtatgtaccacattttctttatttcttttttttttcctttaagttcatgtgcagaacgtgcaggtttgttacataggtatacatgtgccatggtggtttaccgcacctactgatttgtcctctaagttccctcccctcgccccccacccaacaataggccctggtgtgtgttgttcccctccctgtgtccatatgttctcattgttcaactcccacttatgagtgagaacatgtggtgtttggttttctgttcctgtgttagtttgctgaggatgatggcttccagcttcatccatgtccctgcaaagcacataatctcattcctttttatggttgcgtagcattccgtggtatatatgtaccacattttcttcatccagtctatcactgttgggcattgaggttggttccatgactttgctgttgtaaatagtgctgcaataaacatacgcttgcatgtgtctttatagtagaatgatttataatcttttgggtatatatccagtaatgggattgctgggtcaaaggttatttctggttctagatccttgaggaattgccatactgtcttccacaatggtggaactaatttacattcccaccaacagtgtaagtaattgtaaaagtgttcctatttctccacagcctcagcagcatctattgtttcttaactttttaataattgccattctgactggcatgggatggtatatcattgtggttttgatttgcatttctctaatgatcagtaatgttgacctttttttcatatgtttgttggccgtgtacatgtcttctttcgagaagtgtctgttcttagcctttgcccatttttgatggggttgtttttttcttgtaaagttgtttaagttccttgtagattctggatattagacctttgtcagatgggtatattgcaaaaattgtctcccattttgaaggttgcctgttcactctgatgatggtttcttttgctgtgcagattctctttagttcaattagatcccatttgtcaattttccttttgttgcaattgcttttggcatttttggtatgaagtctttgcccatgcctatgtcctgaatgatactgcctaggttttcgtctagggtttttagtatgttgggttttatatttaagtcttaaatccatcttgagttaatttttgtttaaggtgtgaggaaggtgcccagtttcagctttctgcatatggctagtcagttttcacagcaacatttattgaataggagatcctttccccattgcttatttttgtcaggtttgtaaaagatcagatggctgtagatgtgtggtgttatttctgaagtttctgttctgttccattggtctatatgtctgtttttgtagcagtaccatgctgttttggtgactgtagccatgtagtgtagtttgaagtcaggtagtgtgatgcctccagctttgttctttttgtttaggattgtcttggctatacagggtcttctttgattccatatgaaatttaaagtcgttttttcttcttctgtgaagaaagtcaatggtagtttgatgggaatagcattgaatctataaattactttgggcaatatggccattttcacaatgttggttcttcctgtccatgagcatggaatgttttccatttgtttgtgtcctctcttatttccttgagcagtggtttgtacttccccttgaggagcaacttcacatccctagttagctatattcctaggtattttattctctatatagaagttgtgaatgggagtttattcatgattttgccctctgcttgtctattgttggtgtaaaggaatgcttgtggtttttgcacattgattttgcatcctcagactttgctgaagttgcttatcagcttaaggagttttgggctgagatgatggagttttctaaatgtagattcatgttgtctgcaaacagacacaatttgacttcctctcttcctatttgaatacccttacttctttctcttgcctgattgccctggccagtacttccaatactatcttgaataggggtagtgagagagggcatccttgtttttaaccagttttcaaagggaatgcttccagattttgcccattcaatatgatattggctaggggtttgtcataaatagctcttattattttgagatatgttgcatcaatagctgttttattgagagtttttctttatccagtccactgttggtaggatccttggttgattccatgtctttgctattgtaaagggtgctacaatgaacatatgggtgtcttcttggtagaatgatttattttcctttgggtatataccaagtaatgggattgctggattaaatggtagttctatttttagttatttgagaactctcctaactgctttctatagtggctgaactaatttacattatcaccaacaatgtttaagtgtttttgaaccattgcccctttcctctctcccatcttttgtattatccagcatctattgttcccatctttatgttcatgtgtactcaatatatatttcccactataagtgtgaaaatgcagtatttgatttgttctttctttattaattctcttaggattatgtcctaatggataatggatagtgacctaatagcctaatggataatggtccaagttcagagtctcatctgagacaagggaaatcccttccacctagtgcctgtaaaaccagaacaagttagttacttccaagatacaatggaggtacaggcattggttaaatatacccattccaaatgagagaaattggtcaagggcctacaggccccatacaagtccgaaattcaataaggcagtcataaaccttaaagttccaaaatgatctcctttgaacccatgtctcacatccaggtaacactgatgcaagaggtgggcttccacagacttgggcagcgccactcctgtggctttgcaggctacaacctccctcctggatgctttcatgggctggtgttgtgtgtgcagcttttccaggtgcacagtacaagccgtcagtggatctaacattctaaggtctggaggatggtgggccccttctcacaactccactaggcagtgccccagtggggccactatgtgggggctcctactccacattttccttctgctctatcctagcagaggttctctatgaggactccacccctgcagcaaacttctgcccggacatctaggcatttccatacatcctctgaaatctaggcaaagtttccaaaactcaatttttgttttctgtgcacccataggaccaacaccatgtggaagcttccaaggctagggatttgtatcctctgaagcaacatcttgagctgtaccttggccccttttagctaggtttgaagaggctgggacacagtaccgaggctatacacagcaggggggccttggacccgacccaggaaaccatttttttctcctagccctctgtgcctgcgatgggaggggctgctgtgaaggtctctgacatgccctggagacattttttccattgtcttggtgattaacattgggccccctgttgcttattcaaatttctgcagcctgcttgaatttctccccagaaaatgggtttttcttttctatcatatcatcaggctacaaattcccaggcttttttgtttgcctcctcttgagcactttgtcacttagaaatttctgctgccagatatgctaaattgtctcactcagattcaaagtttcacatgtctctagggcaggggcaaaatgctgccagtctctttgctaaagcaagagtgacctttactccagttcccaacaagtttcttgtctccatctgaaaccacctcagcctggacttcattttttacatcactatcagcattttggtcaaagccattcaacaaatctttagggagttccaaactttctcacatctgtctgtcttctgagccctccaagtctctgggaagttccaaactttcccacattttcctatcttcttctgagccctccagactgttttaacctgtgcctgttacccagtttcaaagttgcttccacattttgggtatccttatagcagcaccccactctaccagtacaaatttactgtataagtctgttctcacgctgctatgaagagatacctgagactgagtaatttataaagaaaagaggtttaattgcctcctcacagttcagcatgcctgggaaggcctcaggcaacttacaattatggtagaaggggaagcaaacatatccttcacatggcagtaccacggagaagtgctaagcaaaagaagaaaagccccttatagaaccttcaaatctcatgagaactcactcactatcacaagaatagcatggatgtaaccacccccatgattcaattacctcccaccggatccctcccgtggcacatggagattatggaaactacaattcaagatgagatttcactggggatgttgttgcatatgagatgggtttcttgaagatagcagatggttgggtctagcatttcatccaacttgccacactgtagctttcaagtagggtgtttagatcatttgcattcatcgttaatagtgatatgtgagaatttgaccctgtgatcatgttattacctggttgttttgtggactcgattgtgtagttgctttatagagtctgtgaactatgcatgtgtgtatgtttttgtggaggcaggtattgttcatttgcaggtttagaactcccttaaagacctcttgtaagactgttttggtgataataaattcccttagtgtttacttctctggaaaggattttatttctcctttgcttatgaagcttagtttgacagaagatgaaattatctgaaatttttttaatgatatgaaaatagacctacaatctctttttgtttgtaaggcttctgatgacaatcctgctgttattttgatggggttctttttgtaatagacctcacccttttctttagctgcctttaagattttttctttcacactgactttggaaaatctattgaatatgtgccttagagatggtcttcttatatctcataggggctcaacaaatttcttgaatttgtgagttgacctctttcatgagattgggtaaatttttatgaaatgtattctcaaatttgttttccaagttgcttactctctttctctcacaggaatgctattgcataataggcttggtttatttacataaccctgtatttcttggaggttttctttctttaaaattttttttaatttatatttgtcttactgaattggttaaaaggaccagtattttcattctgagattatttcctcagcattgtctattctatttttaatgcttctaattatattttttaatttctctagtaagtttctcaattccagaagttcagttttgttttttcttaaaatgcttgtgttgtctttctactcttggattattttactgctgtctcggattgggtttcagctttctcttgaatcgcattgagcttccttgttaccaagattctgaattctatgtctgtcatttcagccatttcaatttggtaaggatccattgctggagtgctagtgtgattgttttgaggtgaggagatactctgactttttgaattgccaaagtccttgcactgattccttcttatctgagacggttagtgttattttatctttcagaagttgctgtcatttggatgaggcattttgtttttatattctttttctctctggagggtgtgactgtagtgaatgttttgtattgttaattggctttgtttctgggtgctttcagagggttaagcctctgtacaggttatttaattatagctagatctctacattgtatttcacaggcagtgtgtggaaggcatttttgtttggtggtgtaattcagactgcgttccattagatggcatttaagaataagagtcagcaggtatgttcttattcaactgtgtgccttttttgtatttcagtgcatttgtgtagtgttccaggttggaggagttggggggaatcaggggatgactctctcaccaagttttcattcctgggacttgggggagctccctgtagtctctggtgctgtgcccacatttctttagctccaagggaggcctaggctggcagtgctgtttcctcccatggagtggcctgagccaaaggttaggttggcaggagacccgtagtcccctaggggcctgctatacctctgtacttgacagagtcagagagggttgtggggtatgtctgctggtggtctgttgattcagtcggtcagaggtggaggatcccaggaagggcagtgttgctgtgggtgtgcagctggtgtggtacccagggcctagagttttttgcccagagattgctgtctggacttcccagcttgtgcttgactgatcaggtctccttccagtgtctgtcccagtactgagcttgcccagctagttttgtcccaagccttttgttctccgattgcttgtctgttaggtgctgcagggcatggagctccctcaggcagaggctgaggatggcagataggccacacccttcctagattggtcttccagagcatggtatacccagctgctgtgccatcccatgatcccacacctcagtcttctctgtggtctgagagtgagggctcctctcctgcttgagctcaagatctcagctcaatacccctgagccgtgtgttcaaattctagggagttgagaccaggcatgcagctttgtccttctgcccatctgggtcagatactacctgttctgcgggagggcaaagcaattccagactaatggcgagacactcaggtggggcagtagaggttgcattgtcggcatgctcttgatggagtggtcaggcaggggctttgagggtggtcaatggacaaggggatgtgcagaccagacatgcccctttcccatgggaaaaacagccctgtttcctgcaccccctcatgcaaaatcttctgagttcttctcagatttgagctctgcctctgcttactctccaagcagttcccctgccgattcaaatgttttttggggtcacaggatctctcatagctaggatctcagaggtctgtggcaggagtgtggtgtcccgcagttcctttattcacttcttccttaggacctgttaagggctgagagccagttctggtgctcagcaactttgtgcagcttcctccctcttcatcctcagtgtttgtgttgcctctctgtggactttcagttttctcccagaggatctgcttgaggtgtgatggttcactggatattttggtttctcttggttggagagttgcttcttggctgcatctagtcagctatgttggccccccaactccaaattttcatattaaccttttaattcaacttgctttgtttttgcatgtatgtttgtgtgtgtatgtttgtgtgtgtatgttttgtgtgtatgtttttgtgtgtatgttttgtgtgtatatttgtgtgtttgtgcatttctttatgaatggctaaatttacttaatcagcttggttatacagtcaattcgaatgagccattgagaactttggataactatcactggtttctattgaataaacaagtattaaacatgtaggtgcattccaaaatgtctttagcaaggaaatttctagagataacattccttatcattaaatggctaagattctatatggtaagttatgttttgtaagtggggcaactaaggccagataccatgctctgcatttttagtttattatatctaatgtttatagttttctaacttaggtagatatatgcttattttataaatgaagagcttgagtttaaagcaaataggtgacttgttcaagaacacagagataaattgaatctatacttttttttaacttatatgtataatagaaaaaatccataacaaaaagctttatataactggcaggtgacgttttccaacttttggttaagctgagtaacaaacagtgagttccccatttctgctaatgttttagagaggttgggtgatcatgtgataaagatatattagtgagattcatatagtggatacgaaattattaaaaaataacctctaagttcaacttcaattctaatattttatcagtttatcgccatgtcaacataaaggtacagttgaagctactgttttaatttttccttgttttaggaaaccagttgatacattgttctagacctttcctagggaatggtgtcagctttcacagaaagttgtctgcttttcatttccagtcaagaaaactctagtgtttgacacatagctctttgctctttgatttgattggccatatggagttgttaaaacatttaaaagctgatctcaattggactttcagttgataacaccttggtatcctcttttgtgcagtcataacccatgccagttttcatgagcttgaacattcattactgggttcatgacccaagccattagcccatcactgccatgcacttgtcaacagcatctgaaagcatgaagcttaaacctatctggtctctggtgttattcaatttgtgagtgaaaaaatcacacactacctagttaatgtgtgtatatatttttcccttctcctttgaatttgaatgttctctgggttttctaccattaccagtaatgctaattatttaatttgtctctgtcacccacatctgtgataaaatagtttgtttgcacattgtactccttagcttttaatttctccaagatcctattatatttaaaagatttaaaaatgtgaaatctcttaagtagagaagtcactaagtccttgtagaccataaggattgcctgctctcctcagactcatggttaagtggcatcagtggtctgaaccattcagctgtgttgttctctaaggcccaaccaaccaccaaggtagagaaggaacatatctgtgaatcagtgtacagtacctgaaatgggaaggttagttctgtgtctaggagacatggtgcgcaagttacttgacttctgtcagtggccatatcttcttcacctataggactgagaggataattcctcttatgcctttcttctaaaggcattgtgagcatcacaggcctatgctttctaaacattataaaccacttaaaacattcttgactccatctcttattgaataaaatttatttttcatttctctagactctatgactttgggcaagtcaaccagtatttctgggcattagttttgtcaaagcacctgagtgataaccacagttatttattgggagttgagtatgtgcccatcatcgggccaataaggtttggttaactgtatttattcctcatgaattattttcattgccttcacttgatggctcaggaaatggagcagagagagctcggtaacttccctaggctcacatagctagttagtagcaaaggtggaggtagatgcttcaggtcattaaataaggtagcaaaggtggaggtagatgcttcaggtcattaaataaggagggattaaaatatttcatggaattatcctaggtggcgtctaggttcaaagaatgtaaaatgcagagaataaaagatctgctttttttttctttgttttggccaacttttttcaccagcctgtatttcctctcctttctttcttatctgttttgaaattccaattgctgccttcactttggcagggtagatgggggtggttagagttgccttccctactgtgcttaagttcttattgtgtaaagatcctgtaactcgctaaattagcttaaaaagctctggttttgttttcgtgccagcatattacctcaccacactatcactttttaccctccaagacttgccataccaagtggcagtgctcaaatcacataaagaggagccgttgttgcttgttcgctagtacgtgggtttgtatccccaaaccatgtcttttttacatgatactaattttgtctggaatattcttatttttccatacaaaaagcaaattcctgcttttccttatgaaacatcagtcagttcttctgtatactcaaccatgactttcccagacatcttttttttttttttttcctttaagttgccagcatgacttttatgcttagcaatgtttggattccatgttcctaaaccgaattttctcagagcagggatgctggtttttgctttctgcattttcagcatcaaacacagtatctagcacgtagttacgctgttgtttcagcaaatgaattactactttggtacaacagaccctaattttaatttgaagattgacacaattgtgaaggtatactaaaaagttttcttgaaattttagatgaaatataagtagtagaggatattttttctccttccaaaaattaaagagaagaaaatcactcagcttaattttcgtttaacaaaaaagaaccaaagtgttatgactaacactgtcacagagtatggtgtgattactgatgatcaaacttctgtagcaagttacatgtatatataaagactaatactgttcttccaattactaaggtaagttcttagaagtaaaaatatttatgtttagattcctgaaatagtcactaatcatgaaactgtattgaagcaaaccaaattcctggaactagacagactgtgatagaatccagtaggctgatggaggtactctgcatgacagcggggcagatggatttgctgaaatccagtgttgcccaactacaaatctgccataaaagaaaaatgcaaacatggagacttttaaaataggaataatttggactctcacagaggaacattttcaagttatggtttaggtgggcttcttagagccatcctagattccaagaactaaaagtaactgcagacatcaggcagagatggtccaagttgtcaagcagaaaataaatgcattactcaaaacatgccatctcttcataagcactcttagaatttccatgtttaagaatttatttttttttctaagactgggattctttatatgaaagtatttttttttctccttggttttttaaacatctcaatacaatggcaattaattctggaaagtcaaaaccagaaagcgttttagagagtcttccttactttgccataaggtatttaagatggaagtctgttttagtttttcatagatcttacaaggcccagtccagtgcttaaaacattttaatgttcaattaattttatttgagctaaattggattcatatctactgctcaccaccatccacaagcatcatttcaaacctgtttgggaattaaaataaatgaatcctgggatgactatggtttgtctcaaggtcaaaagctgtgacagagctagatttaacatcaacagattccttcttatttatgttactaatgagtattaatatatattactgaactttttgaccttctgtaatgaaaatttctgattatagatttattttgttatgctaaaatatatgcaattttaaagaaaaaggacaccatcagtggttggcagtcagagccagggattttcttgagagctgatactgaagtattattgaaatgatataataatatattattgaaataatattttttttccattttcttcccaaaggatgcctataatgctctggatgactctccactctcagccttttatatctagcacctcattcctgaaaactttcatctcttttcactattccatgtattctgacagcatccgaaatttaccttacattacttatatcattttcttgtgtataggaacaattctactcattaataccaccactgctgctattgaaattttggttctatgaatatctcaattatattccttcttctttactttattatatagcctttttgtcctggtttattccttagagttttatgctttgcttatatacaatgtacattgctatgtatgtctttaagttagtgtacagatttttaactgtcttaattgttttagaaaaatatctagtcttccaaaagtagatcaatatcagttaattggcttatctaccgagtccttaggatgatgttgtatttgtcttcataatcattgatttatttgttcctgtttgtctttgaaggaaggtctgtctatctagactcagtgtttatttctcttgactttgctgggtcttccaaggtccacacatccacaggtgcagttgcctagctcccagctcacttctcagtgtctaatcaaattccaactgttgcattcctgtaataattgatattgtgtctttacttatcgctccaattcttaccccttcagcactgaaaacagatagtgtacatgaaaaatcacattgcacccccagcagtatctttttaggaagatcggtgttggtcatgcccaagacaaaactccttagttgtagggaccttatatcccgcaatatgtggaatccatcactatcttcttaacccatcctatatacgaagatattttctgcaatttgacgtccctaatagatattgtaagagagacactatagggaggagagggttggaaagtaaaggtcacatactttaagtagtacctaagcagcagacagaccgcccataattatctgataaatgcagccatttgaattttagatgtaatggacagacagtcagacaatagtaccatggcatagagttttttttattttggttttgattatgtttgtttgtgtgtgcgtgtgtgtgttgtttttaaactactttttggcaacatagcctggtggtccaaatgttgggatttttagttaaattctagaaaatatataggtcacggatgttcttcccagtgtcttaaaggttgacggttctagttttcagtgtaatatgatgtctactatatacaactatatatgtctttattaacaatctaatagagcttttggagagcatgtgacaaatacagctaaccaggcacaattttaatattaactatcatatgactttttacttttttacgttttaaagccaactttttctactttctttatacttttctaagtgtttcaaattattaaaatatgtcttataatttttaaagatcctaggattaataaatcactgaaactttaacgaggtgcaatatcaaggcagtcttttgtttcagaaaatgattacaattattaatgaataacaagcactaatacaactttgtacatctttttgttatgtgtatgactgacatttatttatttgaggttatggtaaaattaaaattctatactatatctaataaaactagttttagtatttgtgcaaacagaagttgacatttgatggagatgcaaaaggaaaaaaatactcattattctaggttttagattggaatctaaacatttctaattgaaaacagtttaggaattaaagaaaccttgtcctagttctgccttcctctggtgtgtgtttaggttcatgtcccttaatctaagggaaattagatagctaaaagtcatcagtgaattcagcacacctttattttagcctttgctgtaaattaaggtctgtgaccattattgaaggtttacctgaactccttacaatattagttttccatttcttcttgtcctgagtttgtgctaacaaaatcatacgaagaaaaagagaagaaaggccgaaattatgacagagagagaaatataggatagcttctctgaataaagcctaagcctggggacaggaagtctacagtgtgccatatttctctcctttccttctggtagcccctgggggccattgtgaaatctccagggagtccaggagcacaggatagaaaccatgacatgggaggttattgtgagattaaaggatgtaatatatgtgaactagtaatatgcaaactttacaaatgtaagattcagtattattttactttctatcaatttaatgtattttaaagtagtcatcatcttttcccaatgtattatttattccacatatttgaagcaccatatcatatcacacttatccttaattgtcttcaggtttgcagtatttaaattaaatcactaattcaaattgaaaaatgagaggaactattagtttgtagaaatgtacttattactagattaaagtgtggcaattccagttttttcacgatcaagtgactatgtggtataatatgttttcatcaaaaggctgcatgttattatgaatttttaaaagagtgtgatagtcggctccttttttaaatttaattttaattgaaattaattttaattttaattttaatttaatttaatttaattccaaaatattttctttaaataaaatttgacatcatcatagaaaattatatgatatcaacaaacttcttttctatggtaatattactgtatggtaagtttatatctcattatttctgtgattgctatctgcgctttattttattttctcaagaaaattgaccattttcactaataatataatttactttaagtaaaggataggctctgcatatattaacagagttgtttgagttccagctttcattgaaatgatttcctgagaattgattgcatgccggatgctaatctttactacaatagctgaaaattcacatttcaatatatctaacagcaaatgatcagactgctacccagacagtgtgattcatctatagccatgttaggctgaaagtataaataaatcaataacacacactggtgataaggaaatgttctcaaaagtacatgaaagaaaacaagattatttcataaacaagtctatatattcacaacaaaggagaaagtagaagtttagattattataataaaaaaggcatctgctttatgtataattaaatagtttttctatgagtctgtaaaaacttttacacgaataattgccttatttttcctttgtagttatgattacttaaatatcaatttattaaatgcctgtcctgtgccacacctatattcagtgttagaaagatgaatgagggattataactgaacttaagggtgagataaagctgtgggcaaatatttccagtaaaatgtttgggtgttacgtaatactggaaatctgtttaagacaagaagtataacagcggaaagatggactttctgtggtggaggctttacaaaggaagtagagctttagtagggttttcaagaataaatagaaagtgtgaaatgacaaaggatgggccagagacattccagattgaggcaacaatagtcttcacagtacagatgtggccagagtgctttctgctcggtatttgagaaatgtcttatttctctcttctatgattcaatttattggctgattattctgcccaagccaaaaaatatgtataacttctgtttatgttaatccttgtaaatccatctctaatgcacagagagctgcacgtggaagaaaatgtgttagatcagttttcagatttgactgtacaaaaacttgggttctaaagacatgtctgtggagctgtggaaggaaaagctgcatgaaggctttcctgattccctgcttcaaccagaacagtctcactttaaattggttttaatattgagatttctcatttggaataaacaaaaacattgaattgcaaaaagaaaatatgtttaactgaaatctcctatcaaagacagccttgtggtcgcttttcttgtttaatctcttgtagatgacagaaaaattgagagcttgtttatagacttgggaacacttaggctttgaaatccatatttacttacttgaaggtcagtcatttttgccccctgatgattttagaaaatgtcagggaaacaggcacagtaattgatcatattaggatggagtgaatccatgaagaattgacagcttgatctcgaaagctgtagtgtatgtatgaggatttgtagagaagtagaaaataagtaaaggcctggagaaagcagagtaaacatagagtagaacctgtacagagtcaaggactggtacactggtctcaattctactctttataaacaaaataaacaatggaaagttacggtttaattcctggattacatgatggttaaaatggaaggatagtttttaacaagaaggtacatttaaacaaacaaggactccagggtactcagattcttcatctgcctattttactgtctatttcatctatttctgggaacattatgtacagaaaatataagattaatccaattttagcatgtatcagaatcacctggtggatttgttaaaacatgaactggtaggccttgtccctggaatttctgattcagtaggtttggggtacgcgttaagtattggcatctctcgttaagcgccaggtgatgctgctagtcccagaactaactcagagaatcactgagataaacaaactgtataaataaattcctggaattgagtgtcttcttcaaataaaaacaaaataactcccatttttctgcccaaagagttgtgaaggcctttgttattgaaaacattaaatgaattgttaaaaaattaaaggtttaaacattttgcctaaatgaatattatagtgctggctacatttattttaatgcatttttggggatcgtacaacatctgctactggtatttcccacaaaatttgacctgtgtttcttcaactcttaggtttaccttagtctacaacttttgctttcacccgcccgtcatgtgaattttaaattttacattttgattttcaagttgaactttcatgttgaactgcttatgcttctcaaattgctcctttttctgcaatttaagtataatacaactggatgaaagaaggagtctcttacaaaatgtagctcatagctcataaagatatttgcaaactcaccttttttaagaaacaacaaatgtaggcttttcaataaaatacgtgaacttgagctctttataaaacaccacttgaagatcattgactttgaaacaaactaattttactttattgaatacctttttcccttcttcaaagatttccaatgctgtatattgattgttctgcccttttcaatgtcattttgtttttcttgctgcaaaaccatactctgagttacttaaattgtatttatcattcccagtattatttttttctttagcacaaacccaaacttattaagaatgctgtgatgttaatttcagaagaggatagcactaaaggcagaataattctgatatccaaatatttttataaataacatttgaaaaacagtatatattttggtttagtctactattaatagaggaaagttatagggaaacatattttgttctaataagaaagaatatctaaaaaaacagagcaggaaatcaattaaataatttgctgatactttcataaatgtcttcaaattatgttgtgattaatacttataagaactatttttcaggaggttccagaatagagtgagtgttcatctgagaactcatctgatccccttacagttctaacagggactttatatgctaatttttctcctaatgatggttttctatgtaatgtaacaagtcttaaagttttcttaaatattcatgtattaaagtgtataaaattccttggagtgttttattttagagactttttcattaatagatacaattttgttgattatagtttaaatggaagggatataagtcaaagaaatattattctcaatatgaattatgaaaggagaacaactttaaaaatacttcataatgaagtaagaaaaagagtacatgaaacatcttttgggtttaaagatatgaacaagtgatttctggtgatttttttctttttaattgcaagtctgtttggctatttctttggcttctgagcatctcttaagagagtgaatgaaaaggtaatcattaccctttagaggtaaaaaaagtctctgcaggtttcatagaatctatttgatttcaataagcattaaaatgtgttgtaattttgcagggtatctcattgaatgtagagccaagattgattctgttgagagctcaactagatgaaaaacgtagccagtatgaaacactcttaactggctcacatccttgcagtgggactatcacacacccaggcacccttacttgcggtaactggctactgattcagcaactgaatgagagaaaaagattcttaatgaacctggatcagagaccagattgctgaccagctcctggagttaataatccatcatatgaagtaaacacataaccatcactgaagttagagtaatgtaagcgttgcacctgacagcagtatggtgtagggagaatgagtgcagttattcctggcaggtttgtactggaatcttagcctagatctttactttgactttatgccaattatttaacttgcttttgtcactgaaaatagaaacacaatcaagacataatatctaccttccctcaaggaatttatggaaaacatagtcagttgttgatgctgtcaagttattgatattgtgataaatattatgcacaattacaatagaggtttgtagagctacggtaagaatagtatagtctgcccttggaagccacaggagggttgcctaatgaaagagatcagggaaagtttcctggaggatgggacatcttagctgaacatagtaggaaaagtagaagcaatagctctttagtaaatatgcattcagtgcttgtctcttacatgtcaaacactcagataataacaacataaatgaactgtttagtaggacaattccaatgcaatagaaaatcttactatgcatcttccttcagacgagaacatagatgtttagggaggtcttataagatcattccttgtacagtgccttgaagctgagtggggagtcaaagttaacatttatctaaccctgtgtagtgctctacagaatgttagaatagtagatttgaaagtcttttctattaagattatattgaagctttggaaatgaatgagaatgctaattgatcataggatgaaggggaaagaaatctgagcatatattataccagagggattcccttcccataggaagtaagaatatgaaaaaggagctcaaaaaataagtggaaaaactcgaaaaaggaagaatgttttcaaaagagcatagtcaataggagtagatagtccataagttaaaatggtaataaagttctgatggatttatccttttgcaatttactagttgtattcatccattctcatgttgctacaaataaccacctgagactgggtagttcaggaagaaaagaggtttcattgactcacagtttcacaggcttaacaggaatcatgactgtgaggcttcaggaaacttacaattcgggcagaaaatgaaggggaagcaagcatgtctcaccatagccaagcagaagagagagagagagagagagtgaaatggggcatgccaaacatttttaaaccatcagatcttgtgagaacttactcactatcatgagaaaaacaaggcggatatctgcccccatgttccagtcacctcccaccaggcctctcttgcaacacatggagattacaattcaacatgaaatttgggtggggacacagagccaaaccgtatctttctgccactgggtcctcttaaatctcatgtccttctcacatttcaaaaccaatcatgccttccaaacaatcccccagtgtcttaactcattccaggaataactcaaaagttcaagtccaaggcaaatcccttccacctaggagttacttctaagatacaatggaggtacaggcattgtgcaaatactcccattccaagtgggaggagacatggatctcctttgattccatgtctcacatccaggccacactgatacaagaagtgggctcccaacatcttgggctgctcttcccctgtggctctgcaggatacagccctttggctgctttcataggctggcaatgagtgcctgtggcttttccaggtgcatggtgcgtgctgttggtgggcctagcattctggggtctggaggacagtggtctttttctcacagctccaccaggcagtgccccagtggagactgtatgggtgttccagcctcacatttgccttctgcactgccttaggagaggttttccatgagggctccgcacatgcagcatacttctgcctggacatccaggcgtttccatatgtcatctgaaatccagacagaggttcccaaacttcatctcttgtcttctgcacacctgcaggcccaacaccatgtggaagccaccaagacttgaggcttgcaccctctgaaccaatgatctgagctgtacattggtttcttttagctatggataaaactggagtgctgggatgtagggtgccacgttccaaggctgcacagagcagctggcccttgggcctggcccaggaaacaaatttttacctgctaggcctctgggcctgtgatgggaggggctattgtgaagatctctgacatgccctgaagacatttttctccattgtcttggctgttaacatttggcttctcttcacttatgcaaagttctgcaggtagcttgaatttcttccaagaaaatgggtttttcttttctactatatggtcaggtcacaaatttcccaaacttttatgctctttttcccttttaaacagaagttctaatttcagaccatctctcaggaaggcatatgactgtatgctgttaggagcatccaggtcacatcttgaacgatttgctgcttagaagtttcttccaatagatatcctaaataatctctctcaagttgaaagtttcacagatccctagagcatagcacagtgctgccagtctctttgctaaaatatagcaagagtgacctttgctccagtaaccagtaagttcctcatttccacctgagatgacctcagcctggaattcattatctgcatcactatcacccttttggtggaaacaattaaacaagtatctgggaagttccaaactgtaccacatcttcctttcttcttctgacccctccaaattgctccagcttctgcctgtttcccagttccaaagtcacttccacattttcaggtatctttatagcagtctcccactctgctggtaccaattttctgtattagtttgttctcacactgctataaagatctacctgagactggataatttatgaagaaaagaggtttaattgaatcacagttccacaggcttaacacaaatcatgactggaagatgtcaggaaacttgcaattatagcagaaggtgaaggagaagcacacgtcttaccatggtggagtgcaagagagagagcaagggcgcagttttaaaccatcagaactcatgagaactcactatgatgaaaacaacaagaagaaaatccacacccatgatccagtcacctcccatcagacccattccccaacatggggggattacaatttgacatgagattaaggtggggacacagaaccaaaccatgtcactagtagtgcttggtataagaatattcattaggctgttgagtgttaaagcccagaaatgaggcattagtgggtgaatgttgaaagcgggagctgatgcagtaaatttagcccactcttgctaaaattgtcttggtggagctatagatggaggcagcaaggtataaaacaaatattcatttgtctgcttgtttgtttgaagactagagactttttaaggaattgcttctcttgttattgttaaaccattttgttataaattttatgagatctaatgggaatggtaatatacagcctagaatacgaatttcaaaattataaatataatgattgaatgttatgtatgaacactcagaagaattttgagttttgcccttcatgttaggaaaaggtgtaatttcacaatattcccttcaaagattaaaaagactgggtttagagtattgtattaccaagtggagggataatctttttttttccctttccttttgtgctgctcttccaagatggcattcagaatttgaatttcaccagtggacacttgttgattctaatagtccctttctttttttttttaaattttatttatttattattattatactttaagttttagggtacatgtgcacaatgtgcaggttagttacagatgtatacatgtgccatgctggtgcgctgcacccactaactcgtcatctagcattaggtatatctcccaatgctatccatcccccctccccccaccccacaacagtccccagagtgtgatgttcctcttcctgtgtccatgtgttctcattgttcaattcccacctatgagtcagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggattgctgggtcaaatggtatttctagttctagatcctggaggagtcgccacactgacttccacaatggttgaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttgttttgagaagtgtctgttcatgtccttcacccactttttgatggggttgtttgtttttttcttgtaaatttgtttaagttcattgtacattctggatattaaccctttgtcagatgagtagattgcaaaaatttcctcccattctgtaggttgcctgttcactctgatggtagtttcttttgctgtgaagaagctctttagtttaattagatcccatttgtcaattttgtcttttgttgccattgcttttggtattttagacatgaagtccttgcccatgcctatgtcctgaatggtaatgcctaggttttcttctagggtttttatggttttaggtttatcgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgcagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtaattggtagcttgatggggatggcattgaatctgtaaattaccttgggcagtatggccattttcacgctattgattcttcctacccatgagcatggaatgtccttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgagactttgctaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgtcagttttcaaagggaatgcttccagtttttgcccattcagtatgatattggctgtgggtttgtcatagatagctcttattattttcaaatacatcccatcaatccctaatttattgagatttttagcatgaagcgttgttgaattttgtcaaaggccttttctgcatctattgagataatcatgtggtttttgtctttggttctgtttatatgctggattacttttattgatttgcatatattgaaccagccttgcatcccagggatgaagcccacttgatcatggtggataagctttttgatgtgctgctggatttggtttgccactattttattgaggatttttgcatcaatgttcatcaaggatattggtctaacattctcttttttggttgtttctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactttttttggtaggtaagctattgattattgccacaatttcagatcctgttattggtctattcagagattcagcttcttcctggtttagtcttgggagagtgtatgtgtcgaggaatttatctatttcttctagattttctagtttatttgtgtagagttgtttgtagtattctctgatggtagtttgtatttctgtgggatcggtggtgatatcccctttatcattttttattgcgactatttgattcttctctctttttttgtttattagtcttgctagcggtctgtcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgtcagggtgtcaattttggatctttcctgctttgtcttgtgggcatttagtgctataaatttccctctacacactgctttgaatgcgtcccagagattctggtatgttgtgtatttgttctcgttggtttcaaagaacatctttatttctgccttcatttcattatgtacccagtagtcattcaggagcaggttcttcagtttccatggagttgagcggttttgagtgagattcttaatcctgagttctagtttgattgcactgtggtctgagagatagtttgttataatttctgttcttttacatttgctgtggagagctttacttccaagtatgtggtcaattttggaatcggtgtggtgtggtgctgaaaaaatatatattctgttcatttggggtggagagttctgtagatgtctattaggtccacttggtgcagagttgagttcaattccttggtatccttgttgactttctgtctcgttgatctgtctaatgttgacagtggggtgttaaagtctctcattattaatgtgtgggagtctaagtctctttgtaggtcactcaggacttgctttatgaacatgggtgctcctgtattgggtgcatatatatttaggatagttagctcttcttgttgaattgatccctttaccattatttaatggccttctttgtctcttttgatctttgttggtttaaagtatgttttatcagagactaggattgcagcccctgcctttttttgttttccatttgcttggtagatcttcttccatcctttggttttgagcctatgtgtgtctctgcatgtgagatgggtttcctgaatacagcacactgataggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttgtccgcaaagtattttatttctccttcacttatgaagcttagtttggcttgatatgaaattctgggttgaaaattcttttctttaggaatgttgaatattggcccccactctcttctggcttgtagagtttctgcctagagatccgctgttagtctgatgggcttccctttgagggtaacctgacctttctctctggctgcccttaacattttttccttcatttcaactttggtgaatctgacaattatgtgtcttagagttgctcttctcgtggagtatctttgtggcattctctgtatttcctgaatctgaatgttggcctgccttgctaaattggggaaattctcctggataatatcctgcagagtattttccaacttggttccattctccccgtcactttcacgtacaccaatcagtcgtagatttggtcttttcccttagtcccatatttcttggaggctttgctcgtatctttttattcttttttctctaagcttcccttctcacttcatttcattcatttcatcttccatcactaataccctttcttccagttgatcgcgtcggctcctgaggcttctgcactcttcacgtagttctccagccttggttttcagctccatcagctcctttaagcacttctctgtattggttattctagttatacattcttctaaatttttttcaaagttttcaacttctttgcctctgctttgaatgtcctcccatagctcggagaaatttgatcgtctgaagccttcttctctcagcttgtcaaagtcattctccgtccagctttgttccattgctggtgaggaactgcgttcctttggaggaggagagacgctctgctttttagagtttccagtttttctgctctggtttttccccatctttgtggttttatctacttttggtctttgatgatggtgatctacaggtgggtttttggtgtggatgtcctttctgtttgttagttttccttttaacagacacaaccctcagctgcaggtctgttggagtacccggccctgtgaagtgtcagtctgcccctgctggggggtgcctcccagttaggcttctcgggggtcaggggtcagggacccacttgaggaggcagtctgcccgttctcagatctccagctgcgtgctgggagaaccactgctctcttcaaagctgtcagacagggacatttacgtctgcagaggttactgctgtctttttgtttgtctgtgccctgcccccagaggtggagcctacagaggcaggcaggcctccttgagctgtggtgggctccacccagttcagttggagcttcccggctgctttgtttacctaagcaagcctgggcaatggcgggcgcccctcccccagcctcactgccaccttgcagtttgatctcagactgctgtgctatcaatcagcgagactctgtgggcataggaccctctgagccatgtgcgggatataatctcctggtgtgctgttttttaagccctttggaaaagtgcagtattagggtgggagtgacctgattttccaggtgccgtctgtcacccctttctttgactaggaaagggaactccctgaccccttgcacttcctgagtgaggcaatgcctcgccctgcttcggctcgcgcacagtgcgcgcacccactgacctgcacccactgtctggcacttcctattgagatgaacctggtacctcagatggaaatgcagaaatcactggtcttctgcatctctcaccctgggagctgtagactggagctgttcctattcggccatcttctaatagtctctttccagtgctatctctgtgtctagctaagaaaataggtctcttcctagaaaattgcttttaatgaaggagaggtatgaggtaaaagtagggacattttgctgtcaggcagagcttgagttggatgtataaaaaaagagctggaatagtttttcccttattgccactttccatttacatttgttcccaccattcaattattctttttaaaaaggctagaggaagtgatggaaaaactgaagataataaagacacaaaatgctgaggatggatatttgtgaaaatacataatagcaaccaattgtggggcaggagggaagtcagagaacgctggggtctgtctctcctactctgccacagcatttttgaagcagcatttagtaatttctgcacagggggtgccatacttagacaactccttatgatttttcaatttctcattatcttcaagaagtgttccagaaaagaatctagaaggaacactatcaaagataatgggttacagttttccacaatgggtaaatagcctgagttttcagattaaagaatcacactgaatattgagtgatgatgtggtttggctgtgtacccacccaaatctcatcttgaatccccgtgtgttgtgggaggttcctggtgggaagtaattaagttgtgggggcaggtctttccgatgctgttctcatgatagtgaataagtctcacaagatatgatggttttatacaggggagtttccctgcacaagctctcttctcttgtctgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccatttcagactttgctaagctagtcttcctgagaaatgtcctaatttttactcaccaattgtctgtggatacctctgttttgcacaccatggtcaattcatattcatttaaatatatttaataatttgatttataatgtgtttcttatgcatttaaatatatttaataatttgatttttaatgtgtatctcttatataataatgattttgagcataataaaatagattactctttctttcttgttccaacatttgattcttgcattagctacaaaaagttagttgagattatttctcagcaatgtagagctactttgctgaaagactgctgtatctttttaaaaacttaatccaaagaaaccaatagatcataagaaataaccaaatataaagtatctgtctaaccaatagacaaacctaattagaatactgcctgcatgcttatgtaagtgttggcattcagaaaacaataccccaaagtatgttgctttggcatgctgagcagtttaaactaaaagagattgaagtcacctcagatataaaatctttctcccatctcctgctctcctgtcttctgctcctctttctccctcaaagaaagtcatagaaaccagagttcctcttatgcaaggtgaggcataaaaactagaacccagtccaggcaggttggctcacacctgtaatcccagaacttggggaggtcaagatgggaagatcactggagactaggagttcaaggctgcagtgagctatgatcacatgactgcactccagcctagataacagagcaagatcctgtctcagaaaagcagaagcagaagcagaagaaggagaaggagaagaagaagaagaagaaggagaagaagaagaggaggaagaagaagaaggaagaagaaggaagaagaaggaagaagaagaagaagaggaaaagaagaagaagaaggaagaagaggaagaagaagaaagaagaagaaggaagaagaagaggaagaagaagaagaagaggaagaggaggaaaaggaagaaggaggaagaagaagtgaaggaagaagaagaggaagaagaaagaaggaagaagaagaaggaagaagaagaagaaggaagaagaagaggaagaagaagaaaaagaaagaagaaagaagaagaagaagaagaagaagaagagaagaaggaagaaagaagaaaagaagaacctgcaactcttctgccccaaagcaagtggtgaaacatagaaaggtcactggtatggtttggctcttttctccacccaaatctcatcttgaattttactcccgtaattcccacatattgtgggagggacccagtgggagataatttgaatcctggtggtggtttcccccatactattcttgtggtagtgaataagtctcataagatctgataggttcatcagggatttttgttttgcatctttctcattttatcttgctgccaccatgtaagaagtgcctttcacctcctgccattattctgagatctccccagccgtctgtaactgtaagtccaattaaacctcttgttctccccattctcagttatgtctttatcagcaacatgaaaacggactaatacagtcactttctccattttcttgtctcccttgaggatcctcattccggaggggtcctgccccatacctgggaggaaggagtgctatacagagaggccaagatgaatctgaagagaggcctcactgagtccttcttcagtcgatcaccgttagaccaatcccttttgttcaatcatatttctgtctttcttttttttttttttttaaatcaagacagagtttcgctcttgtcgcccaggctggagtgcagtggcacaatcttgcctcactgcaacctctgcctcctgggttcaaacaattctcctgccccagcctcctgagtagctgggattacaggcgcccgccaccatgctcggctaattttttgtgtttttagtagagctggggttttaccatgttggccaggctgttcttgaactcctgacatcaggtaatcctcctgcctcagcttcccaaagtgctgggattataagcatgaaccaccacgcccagcctgtttaatcagatttctatagagctgtccattcttcactaaaccaaagcataaatgcaatttttcctgagtctttgagtttttatttctgacagcttccctgtcacataaaactttgatttgaaaaatttggtaagcttttatcttcctaatctgtcttttgctataagagtatgactgtgattcttatcatgggtgaggaaaggtatcacatctttccactcctacataaggtatgatatacattttcctctttggtaaacaaaatttccgaaagacaagcaaatggactgtaatgatattctatgactataccacttgggagcaaagttggccatataggaaaggctgaatattaggatttattaaatttatttttaagtgttttaattctgtggaataattggtgtttaggcaatttatataccttatattaatcactcataaatctcctagaaaattaattttattagacaaactttataaaggaggaaagagtaattaaaatactattaatgaaaaggatcaagtgaacaagataagcaaactttgtttcctctgccccaagtcaaactaaaatattctgtgttataaaaagagtataggggagggaaaattttctttatcttgtatccatattaggttcatcagggctctagacagagaaaaggcagattaacaagagaaaaataaacagaactttattgacacatgcatcactcttacctgtgagagcactcagtgatgcgagcactcagtgatgagtgatgatggttagaacctaagcttataaagcatcttagcaaaacaatcattgttgtgtagggaaatgacaagacaaaagaaaaggattttgagcttctaggggcagcatgttgtgggaaggcaaatatgtaaggaaactaaccatagataatggtcagttaataaagtttcttttgttgattcctctgctgctatctcaagttgataagggtctaaagttgtctcaagagattagcttctatccttcctggtagagagaggaggggggcgctgttacacatctgtctcttctttggcaaagaggaaggacagaggttttccttaaatatgctgcttctcaatttcattcctctcacaataatccttatgccaaagtggcatatttcgggggtgacatatattgttaccctttaataaattcatgctgcaatatgtttataataatcagtacatatttgttcattactttttaagtactcagtaaaaaaaaaaaaaactgtaagaatattaaaatatgaagggcaaaatgcctccctttaaagagtgctaaattcagctgtggagctaaacatatatatcttaagatatgtcagtatgtatctttcttttccgttttgaatgaaaaatttcaacatatgatgaagtagagagggatgagatgagatctctgcaggtcctgggtctgtggtgcttatgaacattttcctcctttgcctggcccttctgtgctctgaggagggggaggctgaccccttcacctgtgtttttcagcaccacccccacacttgtttctagcaatagaaggctccaatggagatgggggtgagggggcaagagaatccttagcgtgtttctccctctgtttcagagcttttagcttcaaacaacatgttaacatctggccttagttgctacaacaacttatttttagttttagttttcctttaacaattgaaaagaaattacagagatttactataaatttctcagtaggcatctggaaaaaaattaagatattgtcctcataaccaaactattattatcatatcaaagcaaagtagcaggatttcctttgaactctgttttagttttttaaaattcctaactctcctacaattctgtttataattgatatatttgaatcccagtctaaagaaagtaaagatcccagtcacattgaagtatattttatgcaattggtacattcttattttaaaataatgttattgtttatctgaaattcaaacttaattgggtatgtaatgtttttattcattagatttaggagtcatagccatgtttcacttggttattgtgcttttataggtcataggtaaaatacaagccctgggtcagtggctaaaggtaaatatgatgagctaatgaagctcacattataatttactggagctcacgttataattgatggtaataaacaggcaatacacaattaaatcaacaatatgttgataagtgctgtaaacagagaaaaaaaagtagatgtgacaatggtaaatgtgcactgggaggtcagggacaacttctctggtgaccaagtgacattgccctgacagctaacttacagaaagcacctacacatgtgcaaatattatgcttcaccttcaaaggttaaaaaatatatatgacgtaaagtttctatgaaagccaaattataggtcacatcactttttcattctcagaagaagcgattgaaaatgtaaaccccgtgaggtgggaatgcatgtagtctactcagcaaatgtaaaaaactgaatataagattttgatttgtagggtatcttgagtaaactagaagggtattttgagataaagtcaaagaggtagataggtgccatgttatttaaaggcttttatgacataaggtggaaattggattttattctacgcgtgctgagaagcttaaatataggagaattagatgaaactgattcctcttgcaggagagccacctggctgcagaagattgtcagagatcaagggtaggagccttgggctggttagcagggcatgattatagtaagtcaggtgagagatgtaggtggttcccaccagagttgtagcagtggagatagaagagggatggatttggaatgctgcttggacaaatacttcctggccctctagggtgattcaactagctctgcttgctttttctttatatttgcaaaagaattgtgagtgaacttgtatcacaacatctaaaatgctatattaactttcctgattatgttgtttttttctcctactagactataaaccccttgatgacaaaaatagtgtgcatttcacagcatcttgctcatattcagtgctcagtgcattctggagaggaagtaatttaatgagattttagtttacattccacaaagaatttccaatgaatgtggcttctacaatcctgttaattaaaaggattgcaacaatagtccaaaaaatacacatgatatgtaatctggctattatagaaactttaaacgctattcttttaactttgaaggttaagcttggttcaagagctgcctggaatcacagcaaaagtaataaaacacacaagtttttagcctctttaagggaaaatacatataacttctccaactttcctttaccaaatcatatgactgatattgaactattcttttctcctttgctgcttttgcaatcaaaaccactcccattatcttggtaaagaatgtattctatgattccttgactcctataagcttaatgacatcagcttttaaaatgttgacagaacaaacaaagtgcacacagctgcaacattccctctgcctgcagttaggtgcttttatgcttttactaaacacacacacacacaaacacacacacacacacacacactcatactcattctacttcatttcaatttgaactacatgtggcttactacgtctcagttaatggcaagcaacataacttgttggcttttataaaagttaattattacttgtatattaatttgtttaattttgtttgcccctaaacactctgagaaggaatcattgctattttgttagattttctgctacctctcacatgagcctgatacttggatttccattttttaatgaataagtaaccgatgtaatgaactaaataataaccttgttgaacctaatgttatgaagtcaagtgtgtttgtcacccaaagaattttaagtggctggatggtgagaagagtcccgttagagtaatgcccatgaattataacacccactagcagcaaaacaacacgtgcattctagagtggctcaacctaatgcgtgaggcatttgggaaactcttgagaacatactcacaaaagagtagtattcagtttatgattatttatcttagagcctctttgtgattacttatttggtaaatatatcaatttatagaattattcaacctggcttctctataattattaattcattatttagcattcccatttgttgtaaaatactctctactcttccctgaaactgagttattacgttaaggctcattgatattttattcctcataggcaggatcgtgagggcattaggaagaacttgggtatttctttgttagagatggacaaagtagttctatatacaacaaggttatttgctggacccagccctacattacattgtatgatttttgcctcgtcagctcttattacagtgactatccccttgtagagagatactcaagtattatttgttgtaacttgaatgaagaaacagcacttgagttggaaataggaaaaaggcaactcttcacagtttgtgtttatgtgcccagaaatgcttgttgactacacacaaacaccatgctgaaatataatcatccaacgaaataaagctaagctgagataattaccactgggatatttttagtcaataataattatatgttaaccaactggtattttctgccaaacgagagatggcatttctgttgatgacacgttgcatgtgttctttctacagctgtatcttcatgagtcaacaggctttctctaagtctctctgcaataggaattaacaatcagaccatcttgctcttttttttattgccctttttgctccacttgatgtaaacagggatactggccatttcttaaatgatttttatttttctactatttttctcagcataccaattttcccttcaatactcaagtttaacgttgagagagaaatgaattttgcccccctcaaagcctctgtttacatttagttaatgagataatttgtttaaaggctaaataccattactcatatgctaaagtttcacaccatgtagaaagtttatagaaacacattaaactgaatgccaaaactatctagacctcactaaaaattgggatctatgtgcctcattttagtgaagaagtttgaattaagagagatcacatcactctctctgacatccagggtgaagtctcagcattatggactccatcctcaccgtcatcttgtactagttaacttttccctaactggtaacctacacataagaatattgcactttttcattatgactgacagagatcctagtattggtgtatggagactattagataaaaatcttggcattaaaagcaggagaaggaatatggaaaaatgcagagctgtcaagaaggctaatgcatataggttttaagaaccacatgaaggtactacttttggaacacagtggaaatcaaatgcatgacttatcaacataatcatttttggatagtatgcactacttgaacatatttaactaatccaaagtcttccaaggcttggatatacactggtagaatgatgattaacaacaggacttatatctgtgctttcttatgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactttgatatcatattaatagaaaactctctaaaatatcagccttaacataaattgttgaactgcattttagagttcttactttttcattttttaattcttatatttcacaaataaagatgtatgctttcattaaaacgtgtatacataattacactcatcctcttaatatcacatatatataactaatatttttaagagcataagtggaaaacatgcaaaaccaagtgaatataatttatataggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtctcaaaaaaaaaaaaaaatctatatgtgaatagataagattaaataaaatatatctaatgctaataaatgaaactggtaaaaattgaacagcttatcaaagtctgaatgaccatcgaatgttttagtggtagactagaaactgaagccaccttccacttctgcagaaccatgacaaactgggatagaacccatggtcttttagcctttgaattccagttgctcttagaagttccatatcaggataaattgaggtatgaggagaaaggattgtattaaattcattaagggccaatacagttttctggctctgggaaccattgtgtattctcagagaagaagagagagagcattggaacttgttactttctctactacacagctcatagaaggcagaaatttatttgtttttgcataactacagaactcattaaagaggtagatcaaattttcagacttgatctgtctagggtggtttctaggagtggcaaattataagctggtataccaagcatgaattggagttggctaggccaagtaagggatggtgatacattagggtacttggacagatgaaatagcacatatggaggtccatagatgaaacaatgaagtgtaatctaggacctgaaagaactttgtagttagttgaatgtatacattgaggtcattatataggggagatgaagattggtgccatgaagtgagataaaaattatgcagagattgaattatgcagtttcatcagagattggaaaattatgcagagattgaattatgccgttcatcaaatatataaagaaatttggaatcgattctaaaaactaggaggatacaacaaagtgttttaagtgagactgatgtaatcagattttcatttttttaaacttggatttgaaactagtagagccttagtgtcttagatcctcttaacaatgaaggacaacagtttattcacagacattttaaataagaatgcagatccccaaagaattgaaatgacttacatcacattcctcctaaaaatgtcagtaaaaagattgataaagcccaggtttctgttcttggaggtattcttttgagaatgtgagagatgttaaaattcttttttttaattagaaaatcacattctattataggctgctacatgtaatcaacctcaccaaaaaaaaaaaaaagaaaaaaaaagaaagggaaagcattactgaatgctacctgtcccaaacattagtgaaactgatggataacattttttaaaagtatttatcccagcataatacaattttctattatgagagcgaggtatagaattaaagcaactatcaaaatagcccatatcagatgcaatctttaccctgaataacaagactattaaaggataggagtctaaccaaagggacttttaaaagtgtctgtcatttgctgatggtggcacagattttattactctacaggtcagagggccacgtatttctctgtttatagtgaggtgggttttttttaatagtacatttatctttcttgaatatgggaaatccatacatagttactgtgttagaattcctcactaagaataattctcgataatcaacgctatcaggagttgagggtggcataagagagttcaagaataagatgataatttgatgatggaaaaataagtgagttctcctaatgcatacctcctatcattgtagacaaaagtttatgttctcaaagctgttttcacgtactacactcttcacctctatgtgatttgtttgctagagctgctgtaagaaaattccagagactgggtggcttaaatgaatgaaatgtattttctcatggtctgggtcccggaagtttatgatcagggtgctggcagcactggtgccctctgagcctgtcttcttggcttgcagacccccactcttctgcctctccccatggtcctgcctccgtgcatgtgcaccccagtatctctttttacgtgtataaatttcctcttcttataaggatgccagtcagactggattaatttccaccctaatgacctaattttaacttaatttctctttaaagattctgtctccaaacacagttacattttgaggcagtaggtttagagctttgacatgtgggtttcagaaggacacagttcatcccataataacctccaaagacgtcaatgctaaacagcctccatgagcttattaccaactcaaaaacatcgctttcttcccaggccttccctgtttgttttacttgactgattaatgtatgctgctctttgaagctcagtttctttctccagtgaagacctactgttttcccaccttcttctctaactcctactttgcactggtttacaactcagctcacaatattcccaagttactttatcagtaaaatgttttcaatagatgaaactcatagcaagtcaatacaccattttccacttaaatttgcattattttacattggattctaattgatccatacagctcgattgtctccccatctagtttgcagttgatgagaatgggaatgacacattatatttattttgtatcttcatatgtgttgctgtacatactatatacaatgatagagtgctgtgtatatattatattctcaaatgattcaatttgattcaatttctgatagtgaaatacccagctacctgattctgctggttttcaatgttactttaattggcgtgaatttccagcaattagctttccttcaccatacatactttataaccctctagactgctcaagttggctgggcctggtcttcctgacccagaccattggatgtttaagatcacattccaggcatgaggatggctgcacatctattacctcacagattgtcaagcttgattattactgatgtggatgattatctaggtgtccttatacctcagtgttccccctgtgccttttcaagaagagtattttacccagtacagaacttttttagaaatcaaggttatacaagcaactgtgctcatttgtgatcatcttgaaatccgtaaatactgtccgagtatattactatgttaggtgaaagatttgtgttgctctccacaaattatcaatgtttgtttacagaacatttgtgaaaaataatgtttggaaatgacttgctacgtgaagtaagtaaccagtaactcaagccatttctcccatgtggtctgttttaaaaatggaaattctgtaatctggcttcctcaccttggagtaatatacaaaatgtcaaaatgagaaaagggaccttggtagttgttgtgtctttcttgtttattctttcttgttaaatactcaaagaaagaaaaacagcatgcaatgtttgtagctcccattgtgttagctttttactgtcctgacatatgtcctaaagtttaaaaagcaataaaaggttgctgcttccacagtcattagctttcgttgctgcagtcaatcatccacagaggtcagagccgtatcagtttttcccatcctcattgcacaatccactctagccattgcactcatatatcattaaaggaaaaacgaaccaaggaaactaccgagactcaaaaatgaacttgcaatgtgaaaaatctcctatctccttatttgaggaaagatgctcctgtcacgctgagtaaacaataaaattataaggccaacactgtaaatggaagtattatcccatctattgatttataatgggttaattaattttcaagtgttcttatttgcaaaacatgatgtgaacattgacagaaatccttagatagtttaagatgaagtcacttttgtcttagtgacttgatcacttatacttaggccatagttaagaatctaataggattatttcagcagagtgttgccagattcatgtataaagtcaagaagtaaaagaaaaatataagttagtcatgtttgagttgggtgatgtaacctggaaacaaatctgactggactaataataacaagttaataaactcactgtgaacaaatcaattaaaaacctaggcattgttatatttatttgcatcttactgtctaactagactttagttgaaccacacttcatttcattttaattcaagcactcattgataatatattttgcatttcttagataatttcaaaaaaagatagtgtgccatagtcatattattataagggactagagttatattctaagtcttctgacattcaataaaattgttataattgggttagacatatatgaattacaaaacatgggtttgaaagtggtcacccaagcatgattaggaaaactgcatacaagtagtcttactaaatacaagttgtaccactccttgcttcatccctcagaaagaggcatgatgttgtcactgctgctcatcttcagcttccactttagtttctgactaattctgccctagcattttcttcctgtgcttttggctgtgattttccggttacttgaatttcttgtctgccttctttgagctagaattttcaggtttagtgtttgtattgttctgactttgtgtttgggaagactgctgccacaagtatgtcccggtgtatgtaattatattcttgaccaatgctccttgtctctgtccacataacctctgttgaatcccaaatgtgtacccttggcaagttgctgggtttagtgtgagagtcgatacggcaacatcacatagaaaaaatgttcacggccaatttctaatttgataatgtgatgaaatttatggatgctttcctcattaagatgttcatcacacaaacagctgcatataatttaaagacatattcatgcatatgaacttaaaaactcatggtttagaggtgtttttaatgcatttccctggagtttttcattgtatatgacttttttttttttccttcttttgtcccttggttatattaagctgcctcttaatacttagaaaagcagtgcttaagaaattggaatatctctttccataaatatgtgataaaatgtattgtaacttatatgatttattaaattgagtcacgcctgaagcaaatgcattattaagtagttaaaaaattcatgacatgtccttaacacactgagagtgccttagaggagttcattcatctgataaatatgtgtttaagaaaattgcttgaaatgaatctcttttatgagttttggtaattattgttcttatttaagacttagatatatatagcataaataacagaatgtgtttttcacatagggttgtggtttgtttttgaatgcaaatagtcagtcttttcttggtgggtatataataaaatgctttttttgcatcattaaaagttctcaatagtctatggtgtcctagaacatattatctacattgtatataactatgtttctgttttgagatttaaaggaacatatgcaatagcaactttatatgagatttgatttttcatatcagacttcagcctcaagcatttagttgaagaatgaagatcttaaattttgacttttctgtttttagccagacatgttcaaaataaaagtgctatttaaaaagaggtctgtttccatgtcatctgaaatagggatgttttaatttatgttatagtttgagatacaccaaatcaaaggaacaagcctgcctcaataacccagtataattttcctatggctgctgtcacatagagagcacacttttttttaagttacagctttccatccctttagcacttaatcatgtagagatttgtatcgttgattatgcataaaataatttgactaaatactctgaggcagtgtcggtgacattttgttgctgttggtaccacctcttgtttcattgctactactattagtaccatcatctttgataattactacaatttactgagtgctcgcattgtttctaacatgaagaaaagggctttattttaactatgttgcagataagaaactgagatctagtgattttaaataacacacacaaaagagaagtattgggtggataattatttctgtttctttttgtaatccatgtatgcaattcaacaacacacaataataatagtataaactatgatcaaaactcttgataggctttttataatgcgatcggacaacactatttaactttctcatttattatttatctaaactatttgaataatttcaaaatattctctgcttttcaggctacttgatttgcagcccaaataatctcaaaattgtaataagtcaaggaacatttttagcccgaattattaaaaaattgctttaattttgctttagaatcaactcctcactacccattgcattttagttttatgcgtttctttatcttctattgatggactttgtaatatattaatttatatgcttaaagtcccatttagctatagttttccttttgatttaaatgtaacttaaagagaggaaggaaaatttttatttcatcacaacttcttccaagtattttataaaaattctgatggttctctttactgaacttcttctaagtgtttcataaaaattctaatggttctctttactggcttgtattagcttgtactttctttgctgtaaggaaatatatgagatggggtcatttataaagaaaaaaaggtttaattggctcatggttctgcaggctgtacaggaagcatagcagcttctgcttctggggaggtctcatgaagcctccaatcatgatggaaggtaaaaacagagcaggacgtctcatatggctggagcaggagcaagagacggggaggggtgctacacacttttaaatgatatctcatggtaaatcactcattcactatcatgagaacagcaccaagaagatggtgctaagtcattcatgaagcaccacccccatgatccaatcacttcccaccacacgccgcctccagcactgggattacaatttgacatgagatttgggcaggaacacagatccaaaccatgtcatggctgaatttaccaaatcaactgtgaatggaaagaagtgaatgaatgctagcaagtaaatgtatttcagattaaatttttttagggaactagaagtaaattgccctgtttaaaaaatgaatttataatggacttctagctttggcagcatgaagatgttgtcacattctctccaaaaagcaagtacagatgcttctagacttacaatcatgatatctacccataagtaaaaaaaaaaaaaatcttcagttcaaatatgtttaatacccttatacccaccataatatcaaaagttgtaggttgagagactgtaagtccagatgcttcctgacttacgataggattacattcagataaacccactgtagagtgaaaatgtgtatgttgaaccctagtaactcagggaccatctgtgtgatattggaaaaaaatagaaacaacatttcaaggcacatatgtcaacaaaaagcagaaaacgagttaataaaatttacttttgaaataaatgcaagagttgcaagttagaggagtatctgtggccttctttccaggtcgctgccatcttcactccccacgtcaatagagtcagcaagaatagtatttgtaacagcgggcattgaaaaccaacagtttcgaggctatgcatggggaacttcctcagtttggagtagcaagtgaaaacctatggctttgccagctaaaagtgagtacttaggtgggaacaactgagcaaaacatttgtgttagcacacagaggtcctggttgggggagcaatggaccagcaagaaagttagccaagagattctgaaaatgagcgagccatagaaggtctgagataaggtctcgcatatcactggctattagggaggcctgagagggatttgagaaacagaagctgaggaagacttgaggactcacttcaactttaagtgtgttttccaaaccactcactaataaatgtgaagtgggtagacaccttatggaaacaaagcctttgagtacatcctctatccaaataactgggtgatcactaaactatgaagacatgctggagggccaggctcattcctataatccctgagctttgggaggccaaactgggaggatcatttgaggccaggagtttgagaccagcctgggtaacatagagaagtctttccctgcaaaaacatttttttaaaatgtatctgggctagtggtgtgtgcctgtagtcctaattacttgggaggttgaagtgggaaggtcacttgagctcaggaatttgagattacggtgagctgtgatcaagctatcacactccagtccgggcgacattgtgacaccctgcctgtaaaaataaatgaatagataaatagacgcagggcagtattcctagaaaacaaggcataaaaatacaatagtaatggtaaaatacaattaagtagagtatcagtggctgggctacacatcaaagctaattttaacacacatacacagaaatataaactgcattccagagttggtatgatgcattttctaatatattaaattttcaaccacaaattatgtgatatccgaagaaacatgaaagtgtgaccaatactcaaaagagtattgagtcaatagatattgacactacatgggaccagatattggatttagcagaaaaaaaaaaattcaaaacatctactataaatattttcaaaatattgaaggagtgacatcagcaaaatggcggagtaggattcttgggcttcactctccctatagaaatccaatagcaacacaggaagtataccatcctaaatgtcccagaactcaggagtgaggctaagacttcccttggacccttggacttcaggacaaagaaaaatggaaatcaaatattaagacttcagatgtttcacctcgttgccctttctctaggccaacacagtaccatacacagagaattctcctggacccacagtttctacagttgggaaagttagttggaagcaaatcttcagttttcccaccattcaggcactctttacagaaggctcattcctattttgtcccacaggaaacattgggattacaagcaggggtggaccacctggggtcagttggcaaaaaagagcatttaggagcagctttaaaaaagaatagacaaacctttaactagacttactaattacaaaagagaggttattcagtaaacaaatcagaaatgcaaggcgaggcatcacaatttacaccactaaaatacgaagaatcataagaaactattattaacaattacacaccagtacattggataacttagaagaaatggataaattcctagacacatgaaagctttgaaaacaaacacaaagaaatagaaaactcaatagagcaataatgaacacagagactgaatcagtttaaaaaaaaaaaaaagtcttccactgaggaaaagcgcaggactggacggcttcactgctacattctactaaacatttaaagaagagataataccaattctcaaaccattcaaaaaaactgaagtataaacaatgcttccaaactcattttatatcccaaactcattaccacaacaccaaaggcagacaaggacactacaaggaaaaaaaaaaaaatatatatatatatatatatatgtgtgtgtgtgtgtgtatatatatatgtatatatatgtgtgtatatatatatgtatatatatatgtgtgtgtgtatatatatatatatgtatatatatatggcaacatcattgataaagatacattttttaaatcctcaacgaaactattagcaaacccagttcaagaacacattaaaagaatcatttttcacaatcaagtgagagttattcttaggatgcaaagatggttcaaaatatgcagatcaataaatgtgatgcaccactttaacaaaatgaaaaaaaatgagaagatgcagaaaaagcatttaagaaaactcagcacccttttcttataaaaattctcaacaattaactatacggaaaaaatgtacttcagcacaatatatgacaaacacatagctagtattattcttaacagtggctagttgaaagcatttcctgtaagatcagggacaagacaacgatgctcactgtcactacttctctctttctttctttccttcttttttttttttttttttttttttttttttttttttgatacagagtctcactctgttgcccaggctggaattcagtggcataatctcagcttactgcaacctccgcctcccaggttccagcgattctcctgcctcagcctccagagtagctgggactacaggcacctgccataacacccagctaatttttgtattttcagtagagatagggtttcactgtgttgcccattctggcctctaactcctaacctcaagtgatccatccacctgcttcagcctcccaaagtgctgagattataggcatgagccaccgtgcctggccacaccacttctctttgataaagtactagaaatcagagccagagcagttaggcaataaaacaaaataaaaggcatactaataggagagaaaaaagtgaaattgtttctctttgttgataagatgatcttatgtgtaaaacaccttaaagacatcataaaaaaactattagaactgatcaatgaatgcactagagttgcaacattcaaaattaatgtgcaaaaatcagtagcttttctatattgcaataatggtctatcttaaaaggaaattttttaaaaaatctcatttacaatagcaataaaaaagttaaatatataggtgtaaatttaactgtaaaatacctgagtattagaccattcccacattgctataaaaatatattagactaggtaatttataaagaaaagaggtttaatgggttcacgcttctacaggctgtacgtaaagcatgatgctggcatctgcttgcttttggggaggcctcagaaaacttacaatcatggtggaaggcaaagggggagcaagaatgtcacatgatcaaagcagcagaagtgggaggtaccacatacttttaaatgaccacatctcataaaaacactcactattgcaaggacagtataaacaggatggtcctactcatgagaaatctgttcccataattcaatcacctctaaccaggccccatctccaacactggggactacagttcaacaggagatttaggtggggacaacatccaaactatatcaacttatatactgaaaactataaacattgaggaaagaaattcagggtaatacaaatcaatggaaagatatgccatgttcatggattagaaaaattgatattgtgaaaatgtttatgctacctgtcttcatctgttctgtgttgctattataggatacctgagactgggtaatctattttaaaaaaaaagacgtttattttggctcagcattgtggaggctggaaagtgcaacattgggaagccacatttgatcagcatctgatgagggccttttacttcatcatgacatggaagagaaatggaaggggaaggaggcacacaaaagaaaggccaaattggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacattcaaatcacagcattctatccctggctccccctataactcatgtactcacaatgaaaaatgttttcaacccatttcaatagtacccaaatcttaacttattctagcactaaggcaaaagtctaaagtccaaagcttcatctgggactcaaggcaaagtccttccagctataagcctgtaaaataaaaaataaatgtattttctaaatacaatggtggaacaggcataagatgagtattctccttccaaaagggagagagaggcaaaaagaaaaatcagcccaaagtaagcctgaagcccagcagggtagacattaaatcttaaagctcagaatattcttgtacttcatgtaccttttcctgggcacactggggtagaggaggggcttcaagacctcggacaggcccacctccaagactttgctgggtgtagcccgtgtggctactgtcatggattggggttgcatgctggtgcctgcagatttcctaggctggtgtcgcatgttgctgatgacttctgtgggtctggagtccagagggaagtggccctgctcccatggttccactgggcattctagagaagactctctgtgctgactctgccactgtgacagatttctgcctgagctcctaggcagtttgacaaaaactttgaaatctagttggaggctgctgcacctcctccactcttgcattctgcctgcatgcggaattagcaccatatggatgtggatattgccaaggcttacgacttttgccttttgaagctgcggcatgagctgtacctgggatcccttgaaccatggctggaacagccagagcagctgggatgcatggagcagagaatcctgaggagtgtgcttgaggcctatcccccacaacattccacccttggagacctctgggcctaagataggagaaacagcctggaagatctttgaaatgcctttggggtctttttcccactgtcctgataaatggcctctggctttgttctcttcacactaatctatttagtgaagagttgctgtaccgcacccttggcttttcttctgaaaacagttttattctctaccacatggtcaagcaataaattgaccaaatcttttcactctacttcccttctttctagcagttcactagcagttagaagtaaccaggcagcagcctgaacatttgctgcttagatatgtctacaaagccctaggacagggacacaatatgatcaagttctctgctaatgtctaacaaagatggcctttacaccagttcccagtaagatagtcctatttccatctgaggtctcatctgaatggcttttactgttaatatttctgtcagcattctggtcatgacaactgaaccaatctctaagaagttttaaacatttttttagtcttttttgtcttcttttgagccctcattatattatccttaatgctccacatacagaaatactatttataatagaatattattctacttaaatgataggtaagggaggtgatggatatggtaactaacttgtttaaaagagaaagatatgactatgtgctgtctataagagatgagactaactttagattgaaatataaaaataggttataagtaacttgatttaaaaatctgtaccatacaaacataaccataagagagttagagaggctatattaaaatcagacaaaaacatattttaaactaaggtatattactagttataaagagggatcttttaattaaaaaaaggtcaacacggaaggaaaagataacaattataaaggtacttaacactagagctttacaatatatgaagtaaaatctgacaaaattgaaaaaacagaaatggacatttcaacaaatataattgtgatttcaacacccttttcttaattgatagagaaagaacagactaaataagtaaagatacaacaaacatgaaaaatactattgttgtagaaaaaaccgggttcttgtcacacgaccagaaaatattaggcatgcagacactttgaagagtgacggggagtggaatttattggatgaaaataaaaaaaaccctgtcagcaaagcgagaggggttcctgttaacaggtctcaacctcacagatcgaatcccaggtcaccacccaggaacagaagaggccaggctccttcgccctggaaacagggcgaacttcctgagcctctaccctgtctctgcagtgcgcaggtgggcattattcagaaataatcagtcaggaaaagggaaggcttcatctgggacaggcagcctggtttctcagccttcaggctgtttcagccttcagcctcaggcggggttttgccaggggacccttggctgcctcctgtctctatcattccccctcgaaaggagcacatctaactgcccttagaataaggataaggataaacacgaagaccaatcttaactgcttcctgaagacagagggggctgctttggggaaatggcagtcagatctccctcagaggccaatctaagcgttcctggcaaaaggggccattgtccaaggctctgtttgcatgaccatttggagtctgctggcctgaaggagagaagggacaaaccaggttattagaaaacatgtatccaaatgaaacaaggggtgggtgaggacagctcaaaaacccgaggtcttttacgggtgtgtacatggagagggaggctgaaagcccactggaaaaaaaaaaatacttttacctttttgccagcgtgttaggcttctgggtccccttcccctgagcccagtcctaagccaaccagtttaaggtttgtgaaattaactcttcccagtttggaggatgcatatgacgggagcgtcccagagtatggacacacaattacctatcagtgaagagaggacagaggaggaaaaaggaaaaaaaaagtagtcattttttttcaaaggattcctagggatttaggatgcattcaaaaggggtacagactgaagatgaatggctactcatctagaatgaggagagcaagcgtccctgattcctttctctttctagcaaatacatgcggtacgtgagggagggaaaatgaagcattcctctttctttcccccattcttgtatctcccagtctcggtgaccacgacagggtgccatccatgggtgttaaagtggctttcaaccatgttcacaaggggacttaggtgataggagtatctgctcttacccacatatgccccatctcccctgctgtcagtaaactttgacaggaacaggaactttcccaggaacaggagaggccaggctcctccgccctgcaaatggtacagacttcctgaggctccaccccaatctcccagtgcgcaggcgggcattattcagaaagaatcagctgggaaaagggcaggcttcatctgggatgggcagcccagtttttcagccttcaggctgttttagtcttgaaggtgggcttttgctgggggacctttggctgcctcctgtctctgtcactatcaaccaactggatctagttgacatctataaaatattttacacaactgtaaaatatacattactttcaggcatacgtgtaacactctcaaagggaccatatgctaagcattaacaaatgtctcaatatacatgaaaggactgaaatcatataaagtatattctctgatcccaatacaattctattaggaatcaacaacaaaatgaatagttggaacatcttcaaaatttgaaaattaatcataaagttataagcccattggtctaagacaaccttttgagagatattaaaaaaatcatatgaataaagatggaaacacaaaattgaaaagctgatggaatgtgggtaagctagtgcttagtgagaactatagcttttagccttaattttaaaaaacataaaaaatttaatgttaagaatgtaagattctctccaaaaaactaaagacacacagatcaaatccaaagtaattagaagtaaataaatagtagatctctgagtgaaaagaatgaaaaagaaagtagaaaaggagaaaaacagtaactaaaatttgtccatttttaaagataaaggaaggaaaacaaaaaaaaatactgatagacttttaattagattgaccaagaaataatgagagaagaaacaaattatcaaattgggaatgtgaaaggattctcactatagaaactgtagaaatttataatgtaggactataaacggaacattatgaactactttattccaataactgtgaaaaacctaggtgaaatggataaatttgtgaaagacacaaattaccaaaacaaactcaacaaaaacagaaaatagtgagatctatatcaaaaaaatgaattattaggagacaaatgtgtaaaactgacaaaatttttgaagtcactttactaaagatcacatatgaacagcatatacaaatggccaacaaaagtgaaaattgcccaacatcactaatgattagggaaatgcaaagcaaaaccacatgcgataccaacttacttctgcaagaatgaccataatttaaaaattaaaaaataatagacattggcatagatcttgtgaatcaggaacgcttttacactgctagtggaaatgtaaactactataaccactacggaaaacagtatagagattctttaaagaactaaaaatagatctaccatttgatccagcaatcccactattgcatatctatcaagaggaaaaaccgtcattaaatgaaaaacacacatgcatgcacatgtttatagcagcacaatttgcaattgcaaaaatgtggaaccaccctaaatgtccttcgaccaacaagtggataaagaaatgtggtatgtgtatataccatggaatactactaagccataaaaagaaacaaaataataacattcacagcaacctggatggaaatgaagaccactattctaagtgaagtaactcgggattggaaaactcaacatcgtgtgttctcacatataagcaggagctaatctatgaggatacaaaggcataagaacgatataatgttttgggttttacatttaagtcttcaattcatcttgagttaatttttgtataaggtgtaaggaaggaatccagtttcaattttctgcatatagctagccagatctcccagccccattgattaaatagggaatctgtgtatatatccaaaggaatataaattattctgttataaagatacgtgcatgcatatgttcattgcagcactactcacaatagcaaagacatgaaatcaactcaaatgcccatcaatgatagactggattaagaaaacgtaatacatatacatcatagaatactatgcacccataaaaaggaatgagatcgcgccctttgcagggacacggatggagctggaagccattattctcagcagactaatgcaggaacaaaaaccaagcacccatgttctcagttataagtgggagctgaacgataagaacacatggacacagggaggggaacaacacacactggggcctgtttaggtgtgaaggggagagcatgaggaagaacacctaatggatgttgggctgaatacctagatgatgagttgatctatgcagcaaaccaccatggcacacgttaacctgtgtaacaaacctgcacatgcacctggcacttaaaagctgaaggaaaaagacaaaaagaatgatataatggactgaggactggagaagtgtgggaggaaggtgagggataaaagactacacattgggtgcagtttacactgctcaagtgatgtgtgcaccaaaatctcctaaatcaccactaaacaacttatccatgtaaccaaaaccacctgttccctaaaatctatttaaataataataattaaaatcacataattcttatagtaatttaaacatcattttaatagttctatatcacttgtattgatattttgatataaaattagactaatttgtctttcattttttaatgttttcacttcttttttagttacattttttaatttgtaaaacttttctgtggttaaaatatcaagagccgtagtatgaaaaataaatatacatagaaaagacttactttaggggctgggcgcagtagctcatgcctgtaatcccagcactttgggaggccgaggtggtgggtggattatgagatcaggggttcgagaccagcctggccagcatggtgaaaccctgtctctactaaaaatataaaacattagccgggcatggtggcgcatgcctgtagtctcagctacttgggaggctgagacaggagaattgcttgaaccgggcaggcggaggttgcagtgagccgagattgctccactgcacttcagtctgggcaacagagtgagactccgtctcaaaaaaaaaggagagaaaaaaaagaaaacactcactttaattctgtccattgttgaatgatggctgctcaaaattgtagaacaactggtttattgggaaaaaaaattgtctgtatttgcatcttggtcaaggactatattaccttgataaagtcttagtaaagtattgaaagggggagggaaaattggggtatttatgaagctttggaatatgatttaaagaagttcttttatgagagagtttcattacggagaagcaaggattttaatgatttacatttggttgaggtggcaaggtgaacattttgagaagccttagaaagacttggggagtaagctgtcattttatgccttctattgaagagctgaacaatttgctctttattgaaataagattttcagaaagttcctggaatgaaaagttatttgcaactattatcttcttgggcaagtttcctgcgattataaagtcatgttgacacacatgtagtggaatggttaaatcatgaaaatgtggacagtatgctgtgtgggggtggatggttttggttctcatgttccaccatgattctctctgttccttaacagtgtaatttttgctagtttattcattttccatctggtgtttactttttaagaaagcaattgcaggtatagccattgcttttcagacatttattaatgcttaccacacatttacaggaacaactactgtgaaccatgcatggtgctaggttttaaagattaaaatgatttaaggggaaatgagattttcctccaaaataaaaaaacttactctaacttccagatttaattgctaagcacacataattgcacctaaaacaggttgatgagggattgatgagggagagtatagagaagcgcctgtgtggcaactctgttcacatttaattaactgtctatagatggctgctaccagcattgatcaaatgactacctatacatattttactcttacacaggaaaaaattaaattggatcatgatataatatttatataactttttaccacccatgttttaagatataaattctagattaatggagaatacatcaattttaggcaattttactaagaagagcagatattgaagaacaaaaagaaacactctgtaaatacaggtgtctactcgaaggttcatcgaaatttaaatttgttgtgaattcttcacaatgagacttttcattttcattagaattcttgcagcattattattccaggattggaatacagttgcatatgataatctttgtttcctttataataactatgagtgactcagttaggaattcaccttggcacaggactaagttatttctgatctactcaatggagtgtatgtatttaggattattcatccttgtttacttaatgtggttttcttcacacattgttttttagatgtcgtttgagagaaacaaaacctttaactcttactgagagggaagatgaattttctaaccctgggatttggctgctcactgagtgtacacataatagatgggtgcttccattgtattattaggggcattcagtagagggcctctcatctaccagggcacaattgagtattcctgattattgatttgtttatttgtgtttatatatttgtaattcccctttaaatactaatattatcaagtgttctaccacatgtgatttccctgttctgagctgtctaacattaagtataatggccaaaccccattttctgtgggatttgggattcttgacctaaggaccacccagcaccatgcccctgagacctcccatcctgaacacagctaatcggactggagaagtccatctgaggaagaggaagcagttgtcttctgtagtctgaccaggagattagcaagaagtctggcccaaaaactctgccccacaggtttctctaccaaatggtgaaggccaggtgttcagttactttttcctaaggtgttgaaacgtaaagcatgtggaaaacatgcaaatagaaacagcaaaatggaagcaaacagagaccatgaatcagtaaaatccatgaaattaagggaagtgaaaatcaaagtcggaaaatagtggcagccgctccacagtagtggagcatgagggtaggttatcttcaagtagtgaggtttgtgtaaattagatttctttatattttctctactttttaatgctctgcaatttaaaaaaatgttacttttgtcatcaggataatatgttcaaatttttaaaaagtacctaaaattttaaaaaatcactagcttgatttaactagattttcctttgtttatcatcatgactctgcaaaagctgcagcatctgctgctttatgaatgaagtgctgattaggcaagcaaaaatacagttttccagacctcacatttaggcaactgttaaaagcctagtttccgagtcaaagccagatataaatttctaccctgtgtctcaactcagggccagttatggatggtggagagtttgagatactagtggttaagtttaatttcagctgcctgtgtttgtaaccatttgactttatctaaggaaggcaattctacaccttctctcaataattttttttttccacttggttttctctgacataactgagatcattgacattctgactagagcctaagaaatttcatgtatgtgtctgattcagtggttcaaggccttaaagataagcctttaattctgaggaagagcctttagcttctcccgtctcttaatacaaacctgattcatgccaggtttgtctaggggctacgtggatggttaataaaaacatgtaatttctatcccccaaattgtacctatttaggattagatttcagaatcttatttgaaacttaaacaggctttagaaataattttgtcccactctattattatagagatgaataaatgtactttcaaggcaagtagagcgacttgccaagattacaaaaaaatgtctgcgacagagccgagtctagatgtttatcttctagtttccagccagatactagttttatggctagtttccgccatgctctgagggaggcacattttccatcatcttttatctcaacactgaatactgtttttgacacatagtaggaaatcaattaatactatttaaatgaatacaaatacatgatgtaaaatatatcagagaagtctattatgtgttttcagacaagcttttatttctacagtgtatatttttatgaaactgatatgtatttttttagactaatgtgcaccatcaaatagcactcatttttgaaacattttgagcgtgatatgtatgtaccatcaaacggaattgagtaatatctgaagttgtactgggcactctgccaagatttgtccaaagaaagtaatgtgaaattagctttgcctttctgaatatttacaaaatccaagcaaaaaaagaaaaatccaaagggaaaatgctgatctctggaatactttggacaattcatgcatcaaaagccaactgcagagccactatttgcaagtcaagtctcaagatggtatactatctccaggaaaaggcttggaaggtaagtaagcactactgttgaccccaatatctcaatttccacggagaaaccatatttgttaagatgcagagagatctctctaaagtgctattgccgagattaaatttgagccatctgaaggcttcgtcattatcttagatcttagccttacttgtgccttattctgttctttaactatcacttatgctgcaaactgtgatcctattgtgattttacccttactaggtggttttcctggtaagataagtatttgattctgctcaaatttctcctcttgccttcctaactggtctcaatctttctttctgcttagtatcattctgtctcagcacccgtttatctggctgcgctttggccagtttcattgtttatgattatttggttttggtgcctgcctatatgatcagttcaagtcctagccgtgctggaaaatttctggccccattacagaccagacatttccactcacagctgcttctgtatctatcacaagtatgcattcatgcccatgtgcatcaatcctatatcaatagttgtttctacagagatagcctctgaagtccatccttttgtatatggtcataggtaaactgaaaatgggaagtaacaaggtctctgttaattaaaaggtccattaagggctcaatgccaaaagttggatacgggaaagcttgccaagtgcacaaggttagaaacttaattgcacttctctttaccaagatttctatcaactgcagttctcaaatatatgaccttcctttaattttgtactgatgtataaaatgaggattttgcctgtttttgtacttgccatttggaggacatatatgcatgcctgccataagtggaatttacatatgtatatgtaaaactacgattcttggctttatatcagtggaaaaataaatcagattatgtagatagatctgtctttatacctgatttgcttttatatatatatatatatatatatatatatatatatgcacacacacacatacattcatatttattttaatgggcaaaatatttgagaatatttacatgaaattttttatgtagtaatctaattttggaattgcactatttcttttgtagaactccaaaaataatcagtacacaaatttgaaagcaaaacagtaaacttgaagtcatttttggttactctatcttctcagaatactgaggtaattagactacagggtgtccttcaatacttgaaattatattttgctgtttgcaattaagatgcactgcagaatatgttgtcatggaatggccaccccaatggctgtcaagcagacatttttcttagccaagtcacacaggtaagtaacaaggtagattcaaggttgataaaaagcaaaagcaaatccacacttattggtttcctggtgtgacattgagtatactttgggatttcacagaagggttagtcagagtattccttcctatattttgatcagttgctaatacaggtttgattcctctttcaagtagaaatgactcagctataaatttatagctgcctctgtaggtagttaatgcaggtggataagcaatattgacagcatgactaagtctagccaaagcaggtgcatgaaaaattattagtccattctgcaaaaccctaggccatctattctgtaggatttatctgtcttttccattcccggtatcaagttcttaactactaaattaagcttatactgaagaggaggagctaggaaaatcttccttagatattcagatactcaatattccattaatcgattaattaaacaagaaatcaattaaatcacaatttatttgtgcacttttcatgtgacaagcatttcgctggttctgatctcacaagagataaacataagaaaccatttctgcacactgagaactcaaaggtttttgtgggagtcagaccagttatgaggctgcgttccagtttcaaaaatagcagtttatataaagagattgaaatttctgagaagattaatagaattcagacctgagaagaccgctcaagtcaagggacagtgccagaagcgagcatacccctagctgtgttatcgctgcctggtgatatcctgtgggtctttttattttataatatttcagagatgtgttctgtaactcatatatagggagtcaaattctgttatttctattcatgcctggcatataagactgatatgatcttactgttagacttttcatgaagaatggatgttagattcaggtatatatttttgaagttaaatggcccttgttacagatgtaccagagctccccaatatagaagcagttcttccaatattaattactatgtgttgtatattacaagttgccaaggtaccaatagaaaacacacaaagtcactgaatggaaaccccccaaataatgtaaaaaatatcacctcttttagctcttagaaaatgatgtcgacttctttctaaaggatattgttactggagggatgaggaaaaaactcaatttggaggaaattagaaaataatttgcagtttagaagggggttatcttatatacatgttggtaataattcaacattaacaataaatgttataataacaacatagttatcatagtaaactattttataccaaagcagtagtcccagaacttaacacatactaacttttgattcttattacagtgctatgatgtaggtatgtatgtcaccccgctttagatataagaaaaaaagaggcaaaaggagaccaagtttttccaaaatcacagctggtaagtgtcaaagcctagatcaatctagatagcctggttccaggtgccttagtcttagtcttttcaactgtatgctgcctatgaatttatgatacctcacttcttctcctatgctgtgctcatggtagtttatgttaatttttcagttaaaacatttgtcttttccaagtgtgcggtcatgccattggtctatttttataccactacctttgaacttttctccgtctgatgtatttctcttatctacatgtgtagatcattacctccagaataatagttgtagcaatgggcattgttgccctaatgggaattcttcaattgtcttccccaatatgtgtgagttggctttgaggttaagctaaatatatcttacagagctaaggtttatgtaagaaatcaacttcagaaatccagctgaaagtcagtagtgtgaagagaggtagtcagaatgtaaatcatttcaaaggtagagttgagagcatttcttgatagattggatgtgatgtgtgcaagagaaacagaggattcaaggatgactcattttttgattgtcattgtttttggtctggccagctaaaaaggagaatgtattacctactaagatgtggaaggcctgggaggagcaagttttgaagaaaggtcgagaatttatttattgctgtatgtattaatcagggttcttcagataagtagaaccaatagggtagatacgcagtgagagaagtagtgaaaggtggagaaagagagtgaagagtgagagactgagagagagagagactgttttaaaaaatggcttaagggtttgttaggatgaacaaatctaaaatttgcagagcaagccaggtacattggctcacatctgtaattctagcactttgggaagctgaggcaggaggattgcttgagcccaggagctcagggccagtctaggcaacacagcaagacctcatctcatatttatttttttttaattagctgggcatggtggtgtgtgtctgtggtcccagctacttgggagtctgaggaaggaggatcacttgagcccaggaggttgaggctgcagtgagctctgatcacaaacactgcattccagcctgggtgacagagtgagatcctgtctcacacacacagaaaaaataattaattaattaatttaaaaaactaaaaagcataaacaattaaaaaataaagaataaaataaaatttacaaagcaggccaacaggttggaaattctgacaagagttcattttgtagtctgaaggcagtctgggggcaatattcactcctcttcagtgaacctcagtcttttgtattaaggccttctaatgattgtatgaagtctacaaacaatatgaagggtaatttgtttttaccaaagtctactgattgaaatgttaatgacatctaaaaagtacctttacagcaacatctagtgtttgaccaaacaactggatgccataacctagctaagtggacatgtaaattgaccatcacagcatagtaagttttggatgcctactagacatctaagataaaatttcaaatagcctgttaaatacacacatctaaatatcaagagaggaatccaggcaagagacatacattcttggattcatcagaacacagatgtcagtgaagccttggctcctggttccgcagactgtacaagaagcatggtgtcagtatctgcatctggtgaagtctcagaaagttttcagtcatggcagaaggaaaaggggagcaggcatgtcatacagcaagagagacagcaagagagagaggggagggaggtccaagattattttataacctgatttctaatgagctagtagaggggaggactcactctttactctttactgcagggaaggcaccaagccattcatgacccaaacacctcccacaaagccccacctccaacactggggatcacatttcaacatgagacttggaggggacaaaatatccaaccagtatcaaatgctttacccaatttagcacagtgcccaatttattaaagtaagttttcaaacacttctttaaaaataggtgatatctctctattcctgatgacttaaataagatgaatcaattttaccccaaaactgtgtatgctgcttgaatgctacagaaaagaaagaactaaaatatattttaaaaatatctaaaaccattaaaatgtctcctggtgatatttaaaattagaaatagggcactacttatttaagtagtatattaataatgtgggaattggttgaatctttacctcttgtggttctggaactttccccttgcaattgtatatatctgtagatgacttacattatccttaactgagggaaaaaatgtgttatggaagtatttttgattctggttaatgcactttatataaaatgccaaacgtaaattattagaggtaaagatgaggctttgaaatttttatgaaatatttcggtccagaacttggttaacccaaatcctgtcctgctgatcatgcattctccatctggagttcctgagaggctctacatctgagtatcagagtatcactttgataatcactatttaatgtcttacagtatagtacagacctttggacaaaggatgaggtggtacaaatggagtagacacaaggcctgatgagaactttttaatttattttccccttaatgtgtgtcttactactggtataaacaagcatgcttgcaggaaggagaaagagatggctaaaacaaaatcaatttatccattatggattagagtccatgtataacagagagaaagagctattttcactatagatagcttcagatttatggctcaaaaactatgctgctggattgtgtcaaacagtttagtaaaaatgaaatattattctctcatttggcataagacatcatgttgctcgggcacaatgagtgatcctaaaaatataatatggttatagcttctgttaatcaagaatgaggtaaccagcagcttctgaaaacaaagactggtaatgatggagatctcccttgagacataaatctcatctgtgatcaaaagaagagtagccttggctcctttctggggatccctggcagccatgatttttaagacacattaacaaacaactctgtggcagcaggaacttcctgggaagacaacagtagaaggaccagagtagaagatgggggaaaatatcgaatacctaagaacacagaggaaaatatcagatactcagaaaaatatccaatgactaagaaataactcagaagacagcaggatttcactagagtagatggggatagaatctagaaatacgtaattttattgttataagatatatttcgtaatctttctccctgaaattggaagcaatgcaaacacagggctgctgcagcctctattccagaaggcaacctttctaccctgtagtgtagtggccctatttttttttttttacttctctttttccccacctttctcaattgcttttaattcaccaattatatattaaatctctaccatatgttcagtgtcaaactatatgccagtgtaaataattggtattacccttcacacatggtatgtctaggtccagaaatatacaaatatatgagtaatatgaattgtttaatattataaaatcttcctcagctgccatgttcagtggttgtaaatatactgtggaactatgaatggaaaataggtggaaacaaataaatgtatgctcagcaaattaaaaaattctaaccatgttcttactgctaagaactttctacctgcatatattcctggagtgtcaaacctgaaaatgatcttctgcaacatcagtttatttatattaatttgtatctattagacttaggaaaatagtataaaaacaggaaggaattccatgagggactaaatgaaatataaattcgtaatattttttatacctataaaaatgaggccaggtgcagtggctcatgcctgtaactccagcactttgagaagccgaggcaggcggatcacgaagtcaagagattgagaccatcctggctaacatggtgaaaccctgtctctactaaatgtacaaaaattaactggcagtggtggcatgagcctttagtctcagctactcaggaggctgaggcaggagaatcgcttgaacccgggaagcagaggttgcagtgagccgagattgctccactgcactccagcctggcgacagagcaagactccatctcaaaaaaaaaaaaaaaaaaaaaaaaaaaagcaaggatgtcaaatttgggaactattttctatttgaaactttccttctgtctctaaacaagtttaaaagcagcacccccacctctcaaatgcccttaatagacaatgtaatataaataggtactacaactcactaggtttgattcctgtagaagatgaaaagtgactgctccacggcaagccactatgggagattctttaacaaactcaaatggattcgagagggaaaattgttgatgcaaagctgtttaatgagttctgttactgtgaagtgaaatcagtcctcccaaggatcattcactgtgagaggcagaatggaaacttcctaatgtcataaattgttataccgatatttatagcaaaggcaacatagaactctggagtttgaattagtttttttctctccaagaatacatttttagtattagctgtttgtttcaacctgggaagttttagaagttatttctatctgggcattttcttagcttgacagtttaggtaagaagtctgtgtggctatgccagtagcatatctctttgtgacaagaacatgcatcattctttggctgagcaaaagacaaaattatttactcaagataagcaaagattattggaaggctgaaattgcaaatgatgaaagttctacccatagattttgtttgcccatgactttcattctgtccttgcaaataaaagaataacttgatatatttcattgaataatcacattttatatttccaatttactttattaaaatatgattttagtcctttaaataaagttgaattgagaacaaagagaaaaaaataatatccaataatgtcagttcagatattgtgggttaatttaaggatgaaataaaactatataaatttgtccatgtccccatgagtttctcagtgttttgaggttttgctcagattcatttacacatatggaaaactttttaatatctacataagggattcacattcgaagggatttcattttatccctcagtgaaatgaaatcccttcaaatgtgacttccttacaaagtctggccatagtcttgaattatcttagctgcattttctctaaagcgtcactgtccaactgaaatatactgtgaaccacaaatgtgaatatgacatttaaatagtctagtggcaacattgaaaaaataaaacaggaaaataattttaatgtgatataaacatttaatataacatatttaatatatttaatgtaaaagaagtatacttaattttaataaaataatctagttaaccaaatataaatgttaacttttcatcatgtaacgaatatataagaatgacccatgatttattttgtcttctttaaaagaggtttataatctttgcttacagatatttcagtttacactagccacatctgaagtactcaaagccaaatgtggctagaaagactattgaacagagacgctgtatggtacatattcttattagataactattatttaaggaagtagcataagaagatattttaaatgctaatttaaaattctaatgacaaagccatgttttatatgatatgtgtgaataaaacatagtcagatcttttaagtgaatgttttctttgtatatagagagagctgtttctgtctgtggaaaatttctgctgaggaaagaactaacaaatgacaaaaagaacggctttgcctgggacagtagcagaggaaactaagaaaaaggatgtcctaaaatgagttaagaaaatttttacttagaccctggacatcatagattataaaaggagcatttaatgacaaaaatatcataatgtctcaatgtacagtgaatcaatagtaccttgtgggactgttgtctgatactaattgaaacacagtatttgaaagctacagttgtttggtttgagtatgactgtcttcatcagcaagaataccttacatagtgtctgttctatttgctattttttttctattcttaacttttatgggtttatctttggcaaaagctgattttataaggagaaaatctataaattgcattcatggttatgccaaactcctcaggtacaactatcaaataccagcactttccagggaagattgtcttcaggatctgatcattcagcattttaccagaattgttgttggaatctatggagccacagtctctgttggactctatataactttcctccaacctggtcagaaccatagctaatcaagtaataagacattatgacaagaaataccccttacaaagacaaccaaaagagtcagcatccagtattgttaaaaacagttccaagtgtaaccaaatgtttttacttctcaatatttttttaaagtagcattattatatgtaaaatataagctttgtatggcagtagtttttgcattaagccagaacttactatttttcctgaaaatacttactaatgtacagaacttttttattataaaataatgattggattagaatgtatcctaatgactttcaaacatttaattttattattttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctgcagagtgtacaagcatagcacgggcatctgctcagcttctgaggaggcctcagggagcttttactcatggcaggaggtgaaaggggaggagccatgtcacatgggaaaagcaagagcaaggaagaaaggggaaggcgccacatataccaaacaactaaatctcgtgagaactgacttaataccatgagggcagcactgaactaatgagggatctgcctccatgacccaaacacctcttaccaggtgccacctccgacactggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagactctcaccaggtgccactccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctctgacgctggagatgacatttcaacatgagattctcaccaggtgccacctccgacgctggagatgacatttcaacatgagattttcaccaggtgccacttccaacacgagatgacatttcaacatgagatttgagtggggtcaaacatccaaactacatcattctgcccttggcccccacaaaattcttatgcttctcacattgttaaatacaatcatgccttcccaatagtcccccaaagtcttaactcactcaagagttaattcaaaagtccaaagtttaaaatctcatctgagacaaggcaagtcttttccacctataaacttgtagaataaaaattaacttatttacttacaagatacaatgaggttataggaatttggtaaacattcccattcccaaatggagaaatcagccaaaagaaaggggctgcaggccccatgcaagttcaaaacacagcagggtagtcattaagtcttaaagctccaaaatacactcctttgatgaaatgtcccacatacagggcacacagctgcaaggggtgggctcccagggctttgggcagctctgctcctgtgtcttttccgcactgaagtttcaagctgctgttggcaccacccgtctggagtgtggaagatggtggctcccttcccacagctccactaggcaatgtcccagctgggactctgtgtgggagttccaaccccgcatttccccatagcactaccctggtagagtttctctgtgagggctctgcccctaaagcaggcttttgcctggtaacccagcctctctcatactttctttgaaatctagggtgaggttgccaaaccttcactctcgcagggtgcatgcctacaggcttaacactacgtggaaaccaccaaggcttatggtggcttatgctctctggagtggcccaagctgtactgtgaggcctctgagcagtgactggaaccacagcagccattatgataggaggagcctcctgaggtaacactgggcagtagcactctgggcctattcccataccaccaaaaccattcagtccccctgggcctctgatgggaggggctgcctagaagatctctgaatgccttggaggcctttttctcattgtcttggctattagcacttgactcccttttagttatgcaaatttctttagtaaatgattgctgcacaacctacttgaattcttctcctaaaaatgggctttttgtttctaccccacagccaggctgcacattttccaaatttttatgctctgcttctcttttaaatataacttccaaatttaagtcatttctttgttcctgcatttgaagctggctgttagaagcagccagacaacttcttgaatgctatgctgcttagaaatttcttctgccagataccctaaatcatctctctgaagttcaaacttccacagatccttagggcatgaacagaatccagccaagatgtttgctgagggataacacacatgacatttgctccagtttccaacaagttcctcatttccatctgaaacctcagcagcctggacttcactgtccatatcactatcagaattttggtcacaactatttaagcagtctttaagaagttctaaactttccctcatcttcctgtcttcttctgaaccctccacactgttccagcctcagcccattaaccaattccaaagctgtttccacattttcagctatttttataacaatgccctatgccttggtaccaattttctgtattgggctgttcttgctttgctattagaaataccttagaccgagtaatttataaagaaaataggtttacttggctcttggttctacaggttgtacaagcatagtgcttgcgtttgcttggcttctggggaggcctcaggcagcttttactcatggcagaaggtgaagcaggagcttgcacacacatggtgagatgaggggttcaggggtaagagaggtaggggaggtgccacacacttttaaacaaccagatcttgcaacgacagcaccaagccatgaggaaaccattcagatgaccaaagcccctcctaccaggccccgcctccaacgttggtgatgttagaaatgctcgtttcccagtgccgtaaagaaatagcacttgaacataaatttaacttcctcagcaaggccatttttagactttctgcagaaaggatacactcgccagcagttttgccatgagagtatattgaacaaaggagactgggttatttataacctgatccatccactctacttctgtgtccagtttttattggctgaatcggaccttatatttagatggagaggaaagtctctttgaagaggaacctctactttactttttacagtgattacatttctagatgagatttgggcagcaacaaatattcagattatatcaggtagcgacataagaaaagtaaagggaaaagcaaaaaggagtgaagaaatgtacagaagggagaaaaaaagaaacaccgaaaaaagaaatagaaatgataaactttaaccgtaattattttagtgaataaaattttaataaataaaggagggcattttgtagttttttgctttatacatttaaggaatttttttttcctaagcttttcttactagttttaaaatatattaaaaaaaattaaaaattgtatacgtgcatctgcttttcttatttggaggctactgtaatgtttaaactgcattttatttattaatatactccttgtgtgagaaaggaggctcacaaggctatgtaaaattcaacaagctagcataaataaaatgtttggaaaaaataaatgacaaggcaatatgtgatcttaaaacagagtggtaatgaggtttaaaaatatataacattatgtccaaaaatgagattccattatgtctggcatgtaagaagagctcaaaagaagacagatttattttatgtgcttaataataaaagctaattgatgtattctagacacaatacccacagtgtcctcaggactttaaaaatctcatgcatattttacaattaaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgtgtttagaggagtgtgactggaagtggaaagacactttttatgacaagcgctaaaagaaagcagttcgttttggaggccttggaaaaagagcagggacacaggttctgcgtggtattcttttgcaaatacctgaaaccactagttgggaaataaattaaatgaattaataaactaggaactgtagtttgaagttagatggagtggatttggaaccgatttaagattttttaatgagcagatgattgatgaaattaattgtcacacaaattgatgtttgctattaatatttagctttaactgaatgaatacaaggtcagtgctcaaatattggaaatgttcctggactagacaattctaagattgctacaatgctgccagatccaccgttggactttccttaattcttattcaataattaatgaatatgaaattaatcttcataatgtaacattatgaagcacagaaacataaaaacaagtttatctgtgaatgtatcatagagaaaaatgagatttaacatttaaaacagtggataatagtaacattgaggctcctttacatctcgatagatttttaatgtctttgtccgtcaaagtattcaagtatttgtggaattcagctatgtaccagaaataaagtagatcaggtaatacaaacaaacaatttaatatatttcaggagaaaaattagaaaatattcctccttttacaacacgtataaagaaacagctaaattgataatctcaggtttttgctttgtattgaattttctacccgaaaagccttgggcagtactttttcaagaatgatgttcttttcatatttgactttaataaagacagcacattgcccgcgtccataaaatggtagatgagcaaattgctctgtgttttactgctcactcgactcctacattcatagtatttgacaagtaggacttaaatgggaacacttctttttttcttggagagggcagttactctgaaatcttaaatgaatcatattggagtaaggtgacataaatttccctcctcatttattaagatccaatctgcatgcagtactctgccagacacattatattaggttggttaaacagatatgatactagcttcttaagagaataaaaatcagatgatatcaacatagagacccagggttattattcatgacagtgccctgtgattcttcatgaactaatatagctcgcgaaagcgaagggatccaggaattctgtgataaatatgaggcagtttgtcctgaccagagatctaaagattgaaaacagtcatgagaggctttttgagagtctggaggacaagtccatgactgtaaggaggtcatggagaaacaagcaagtactgttacctgagcatcggtttgagtaacaaggagtagacgacgaagtgaaaggaccgagggataaaatgttggtgcccatggggtaagataaccatatcatgcagtcaggaatcccaacagaaactcttgcatattactaggtcaggatgcagatgagggaaaaaataaacatggactgcaagcatgaattctgatactgcagtggtgtagagatagcactacctacagcattctgcctaaagccaatgatctctgagtgggaattgacaaaaaagcaccactctttagagctttaggaatgagaatctaaaagaatttctcacatctccgctagccctcttggactctccattgtgctaatcatattcagtgctggtctctaacacttcaggggtctaaccgaatcacttttcttgtgtttgtgacccagcttgccccgaatgcacaccctttggatatcatccctccattcttggcccaatattgtcccttcactccttgtagatctgaatttaaaagtagaacaagcaggcacttgcatctgcctaaatagtcatgtgaactacattttgaacactagtgttctgaatcttcatttctgcaagatatctttaaagtgggatttggaattttgttagaattacatcagaattattgataataaggcaaataagctgctttccaagggaaacgggaaatctgtatactgtatagtgataaaaatgatgccattaaacatcgtaagttaagctctataaattacccatactccagatagaaaagcaaaccaaacagaattaacccagaaaagggatttcaaattatatagttaacatttgttttccttttttctaccctgggacttattgttatctattagtcaccttccttagaaaacatcaagtctgtggataaatacacttaatagtgttagcaggaatgctattcatgacagacctcaacatgttgactcgtactttatttaagctattatgagcttggcgaaaatctgaaagaaagacgatgcaatttattttaggaaatacttcttaaaagtaaagatttcaaatgtgggagatattcatgaatagaaagagttggttttgctctcattggttctgcttgttttgctactgtctagctatatgagggactttaggaaagccattcctaataaggtgggttttagttttctcatctgtgacattaaggaattagaaatgatcatgtaaagggaccatttccttctgttatactatagattgttattgatacacaaaatgattggttaattcaagttcaattttgttaacctgaaatattttgaattacttttgagagatccttgtttaaaagccataggcaattttgtgtgtgtgtgtgtgtgtgtgtgtgtgtgtgtgtgtgtgtcttttagctcagtggttatcaatggggcaatgttccctttcagcaggcatgaaacaatgagatattattgattgtcacagatatgggagagctactgcattgagtgggtagagactacaaatgctgctgaacgtcttctatgcacaggaaagccgtcccttaacaaataattatttggtccaaaatgtcagtagtgccaagattgagaaatcgtgcaactagttatggtccagattgatggcatacctcatccttcatgatatagtgatccaagtgccttgtcatctaaaccaaacagagcagaatctccaactctccctgccctgagaaaagggactctattttctgtcagacagtaaggattggagaccgtatttgctctcgtgcttgagagcccacatcattattgggttaacagtcatagctagagaattcagtctgtgtattttttttattagtgttattttccctttctcgtaatgtaacaatttttataaatgtttcatgggctatgaaagaagggcatttttcattttcatgccactgctttagcaatgtatagatacaatcaatattatggattgtgatttaggtgggtgttctatatatttacagtcaattaaaaaccattgaagagcttttcattgatttcattaatttctattatcttaataattctatattcaggcagggctactttagctatttgtgtgtatgtgtgtttccgtgtgtgtaaatgtataaatacatgtacatgtgtgtgtgtgcatatacatataaaatcaaaggcatacctagacctaaacaaaatattctgttctcatgatgtaattaatctcataagcaagataccattctctgtgtgacacagtttttttttctagttagaattcacattcactaaatgtttaacactctcttgatttcactttaaaaatagaacatcaggctcacatatggctgctctctacactagaactaccctcaggggtgcacaaattgaatacactcagtatttttctcctggagttttttaaaaactccatttatttccttaaacttttgagacaacagggctgatgttttctgtaatgaagttagctaaatgagctttttattgaaatttattcaataagattcattcttcatgtgtcaatcagatatcacgattaccatgctcaaatccaaattcaaatttttgttttatgagatttcctacacttctggagacttgaattctggtcttctctaacagtcattatctatttatctttaaataaataacttctgtacactgtggattgctttatttatactttggtaatagttttctgctcaatttgacccagagataggctcaggtagtaatattaagggcttctgaaaaatatcaattactatacatatatgagtaatggtggtagtataatttacacattagacagcaaagcaaatcaacaaaaactaaattaaatagggcaaaaagatgctgtggtacgaaattttctggataattttagttttagatcatgttgttaatttataattgagaatttgataaattagttcaatcttcattaccaaccatttgaaacactggctgatatcatggccaggtaaattgtgtcctttttttattaaacgtagttgactgaacacttgcttttcacacattgaattgggtcctggcaatacttggatgaatcaaattgtttccatatccttgagaaactgccagtgcaggcaaaatagggtaacagatgtaataataaatgcatgcacagcatagattggagcaaatggaagcactgacaaactcttcttttttaaaaaaaataattttcatttttttgctgatccataatgtggtacatattttggaggtacgtgtgatagtttgatgcatgtatataagatttaatgctccaattagagtaattgggatatttatcacctcaagcttgtatcttttcttggtgttgggaacgtttcagttcttctcttcttgcttctttgaaatatatttttaaaatgttaattatcatccacctactatactgtcaatcactagaacttattccttctgtccgcatttttgtaaccattaaccaacttctcttcatccctccctccccaatacccttcccagcctctgataaccaccattctaccctctatctccatgaaatccacttttttagcttccacatgagtgataaaatgcaatatttgtccttatgagattagttaatttcacttaacataatggcttctagttccatccatgtttctgcaaatgacaagattttattctttttatggctgactaatatttctatacacatgcacacatatatatatatatatatatatgtatcacatttctgtattcattcatctgttattccatatattggctattgtgtatagtgctgtaataaacctaagagtgcagatatctcttcaacatgctgatttcctttcttaggctgtgtacccagcagcgagattgaataatatggtagttttatttttagttttctggggaaggaacactatattgcttgtttttcatagtggctgtactaatttacattcccaccaacagtgtgcaacagtgtgcgagagttaccctttctccacatcctcgttaccattcataatttttgtctatttgataacagctcttttaactgtgatgagatggtgtctcattgtggtttgattctaatttccctgatgattagtgatgttcaacattttttcatatgcctgttgaccatctttatgtcttcttttgagaaatgtctgttcgggtcctttgccaatttttaattggattattattgattttttttgctattgagttgtttgagttccttatatattctgattattaatgccttattgtttggataatttgcaaatattatcaaattctgttggctggctctttactttgttgatttgtttcctttgctctgcagaagctttttggcttgatttaatcccatttgtctatgttgctttgcttttgttgcctatcttacacaaaaaatctttgcccagattaatgtcctgaagaatttccccagtgttttcttctagtagtttcatatgttcatgtcttacatttaagtctacaatccacgttaagttgattttgtatatggtgagagataggggtcaagtttcattcttctgcatatgtatatctcattttcccagcaccatttattaaggagcctgtcctttttccaatgcatgttcttggcacctgtctagtggacaaacttttaatttttctgtgagtaaaagcatttggacagatgttattgggagtggtaatatcattctttgttttacaaaacaactctgttaatagtggaaatgttaggtcaaaagggtgaaaaatgtttttcagagatatcaataaaagtctattgcaatgcaaaataatgtattgggtatggaatagttacaaaaatctttgtgatcttgattaagaagtgatcattctacaaatagtgacatgttgaacatataccatgttcttacctctgtgtttgtcatctcatataaactaagtgcaatagataaaatttggtttaatttgtctctacaaatttaattgtaagagtttaggatttgggatatcattaactcttttaaatctagagacaagcacattgcaaaaagattttttttttaattatcaggtattaaagacaactgagaagtgttatactgaaatacttaaatgacataatttaaagattaaaatattgaggtaagtgttagggtataggtctcacttagaaagtacctgatttttgttcattggattcttaagcacactcattagaactcaaatattagacataatcaatcaaccacttttaaacattatttattgaggcccatttagaatcttggcaaggtatgatgctggatgttacagagaatagggtgggtattgaaaaacaacaataatgaaaaataggacaggaacaaacacttgggagtttaaaaaatatggaaagctattggtctaatttgaaattttctttttctggttctttaagatcattcagtttatgtgtacaactgtattttgaggtagaaattgggatatatatatgaggcattttaaactgaaccatctttaattaataatttattctaccccaataataattaatattctagcctaccaatagtaaattcaaaattgtggtctaacagtatgtaagatactgcaatttcacaaagtataagatacaatatttctcaaaaagaagcatatagtctcatatcggtaagtaatcacctgactatgtgacgttaaatcagtgtcatttattgataattacacaccaaaggaatgcagcattttagagtcgtaagagacttccaaaatcctctaatctggcctcttacatgatttcatggaaaagatgtttgaattaattcaaaataatggataatagggtgaagacattccctaataccagcaaggagatttctactgaattaactctcttctagtggatagctcaaggggcaaccttttttatacatacaaatcaccctttgattgtaacctcttacgtaagttttcagcattagagaagaaatatatttgcctatttctaactttatagagaggattgaaattgacccagtgctccatctcatctcatgccattcaaatcactacacagattccgaaaaggagtctatgaggatgaagtggagtgaaaatgattaaaagaggaacttgctagaagtggtttaagttaagtgtgttactcaatgatcttcaggttgataagctcaactttagtattatctaagttatttatgacagtttcacagataaacgtatatgtggtgctttgaaaattgaaaaacgatgctggataggaaaacaggtggcaactgaaatattcataatccaatgtccctttaccttaatcatggactaaacaacagtttacagtacagtgtgtgattatattaagaatatgactaaacatttatgttcatctagtagaaaataggtgtgaattttgaaagtgataaatgactaccttggtggtattgtaagagctgtcaccaaaaatgagcaaaaatgatacaacgttttgttgtgtctaaatttttattcaaacaatataatttcttttgtaacatatgtctcattttattaaattcattttatgtgccacatattgccaaacagctcacattcaagtacttcaggagaaaaagttgtatctgctttgtatattgaaaataatcataagtttcttcatatgactagggattcaagctgaaaaaaatgagagatgggcctgttaacgtggatgaaatctcaaattaaacaaaaaccatgattaaaaaatggtgagagtaagcacgtgaaaagatgttaaacatcactaaccattaggaaaatgcaaatcaaaaccacaatgagacaccacttcacattcattagaatggctgtcatgaaaaaaatattgcaacaacaacaaaaataacaagtgttaacaaggatgtggagaaattaattggaatctttgtgcattgctgctgcggaagaaatggtgcttcctcaaaaaagtttgcatagaataactacatgataaagaaatgccactgctatgtatgctaggtatatactcaaaagaatggaaaacaaagacttgtacatatacttgcgtgccaattattataccaacattactctcagtagccccccactccccgaaaagtagaaacaactcagatgtttattgatggatgaatagaaaaacaaaatgtggtatatacatgcaataaaatattatttagccttaaagaggaaggaaattctgacacatgctatcccatagatgaatcctaaaatcattatgctaagtgaaataaagcagacacaaatggacaaacagtatgattccactaacactatgtacctaacacagtcaattcatggaagcacaatgtagaatagtggctaagatggtcatggaagcacaatgtggaatagtggctaagatggtcatggaagcacaatgtggaatagtggctaagatggtcatggaagcacagtgtggaatagtggctaagatggtcatggaagcacagtgtggaatagtggctatgatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagcggctaagatggtcatggaagcacagtgtggaatagtggctaagatggtcatggaagcacagtgtggaatagtggctaagatggtcatgggagcacagtgtggaatagtggctaagatggtcatgggagcacagtgtggaatagtggctaagatggtcatgggagcacagtgtggaatagtggctaagatggtcatgggagcacagtgtggaatagtggctaagatggtctggggagacggaataatgtgaagttattatttaatgagtacgaaatttcagtctggaatgatgaaacgtgtcaggacataacagtgatgatgtttgcactgcagtgtgaaaacccttaacaccactgaactgtacacttaaaaatggttaaaatgatcattttatgttacatatattttatcacaacaaaaatagaatattttaatcttgacaaacgtaaccacagaaaacaacttacaaaatagaatttcagaaatttttgctaaattggaatacatgctgttttatttctacgagaagatggatagtaggttatttggagctgaagaattataatgcagcttccccaaattgtgatctcctatgtggcagtggttagaaacaaataaaattcttatctcttatccttaaagaaaatcgaaattaccacacatgtatttattcagatagctgttctgagttagacggcaaaatagagcttttattaaaaagtaggatatattaaatttaaacatatataatgtgtagatcaaacattcaaaaagcagaactaattaaaaactggataaacattttagaccatattaaaaattttaggccgcctttctaaagtctagattacattggattaccattgtagaattgaagagtggttggttttgaattttacagttgtaattgcaaacttgcaaaaatatatattttaggtgctactatttcttaattttcattttgtaaattaactagctcttttgaacagcatttttttttcttagtatgatgcctatgagaaaaactacctgccttggaggaatttgtaatagagaaagataatatgtgtgtgtgcgtgtgtgtgtgtgtgagtgcatatgtaaatatttccatatattatatgaaaagtgaagttgaataacaagagaagtttttctttgctaaggaaaaaatacatttgtttttcattaagtaaagattattatactggcattattttgttcttacattggttttcagaaagttcaatggcatattccgctgtatgagccatgcagagctgcatttatctactgtattatcttcctcccttttttctagatattccttttttgtctgtgtttttcttcctgctggtttagtgttatgcatatcttattattttactatgcaatttcttatcttgttgtacccaagcgagttagtgagaacgccacactatgagatgaatcaagagtcctttattaagccggcggccaaagagacggctaacgctcaaaattctctcggccccgaggaaggggcttgattaacttttatacctaggtttaggaaggggagggggactcaaatgcaataattctacagaagtaaaaacatgcaagaatcaaaagaagcaaaatggttacagagagataaacaatttaaaagacaaatggttacaaaaagagcaacggtaccaggtgcaaggctctaaatctttcattataattagatacagggagtatgccggacaggaactcaaggctttatgttttctctctttaagaaaaatcctgggaacttcatacattgttggtgctagtaccttatcagttcattgggctcctttgaaatgctgaggatctgcttacacaggtcaactcctggcagaagcgggttgggtaaggagcccttagtgtcttgtaaattatggggtcaattggagtttttccggctttcccagctagagagagtcttatttacatgagaagcaaggctaggtgattaaagagacaagcaggataaaattcaaagtagcgagttagagtaaaaacaaggttaggcatttcaatcttaacgtcagaagattttgaggttaaataataaaaccaaatctaataaaagtaaattataaaattggtcacaggaaaaaaagggggaaatagataaatataatgtaaagagccaaaggtgagttgaatatagtgctgtactgaatcccgagttgggattaacctagacttgcagctggagttcttcagcaagctgtgatgtctctgacctagatttagctatttgatatgagatcttgtaataggtgaattttgttatgtgaagttgtgggggatgaagttggaaaggactttttatgtgacctagaatcatctgtttgtcatttgaagtcagatgaactattctctcttctgggaatctttcctacttctgcctattcatatttagggtaaatgattattgtgtttatctgagatgccctatggttatgtttgaatattacttacctgtctcaacaatgtttaatacggtagccactagtctatgttagactattgagcacttgaaatgtaattatttggggctctgagtttctcaaatcacatggttggaataaatttagactgcatacatgtggagggacagacctagttatttgattcatctttcccatgatgaatttaaacttttaaatttttttgtcagacctatgtcaagacaagtttcttttttctttctttctttttttttttttttttttgacagagtctcgctgtttccccaggctggagtgcagtggcacgatctcagctcacttcaacctccacttcctgggttcaagtgattctcctgcctcagcctcctgagtagctgggcctacgggcgcaccaccatgcccagctaatttttgtatttttagtagagacgggatttcaccatgttaaccaggatggtgtcgatctcttgacttcatgatctgcccgcctcggcctcccaaagttctgggattacagacatgagccactgcatccagctgacaagttttttttttaaatttgttgcattggttaagtttttttgtcttcactgtgcttgtactctgttaaggtcctagatttaatgcacaagcctcagttttaaccaattagttttggtaggcccaaagctcactggctctgtaagaggatcagaatctaattccttgatcagatatccaggtccagtgctcctctgctcctaccccttgtcaccacggctcttgcaatatattatctgtgtgtgtgtgtttgtgtgtgtgtgtgtgtgtgtgtgcgtgtgtcgtttcattagaaatctctaggtgttattttaggattgtttctgagttagcgtaattcctgatttgggggatcaagaagattttattaacagtattcagtgtccagtggaatgttgcttaggatttgtaagagaggaagaagatcaaaatagtgctttctgaagatttttctggttgtttgcctgtgagcatattacaaaggaaagacagtcgaacaagatgccatttatttaatggctttgatgatgaatgagaggaaacttgttttaaactgaacacaaatctaaagacaaatttactaaatataatttgtccttttcagatctatgtacagttactctcccttacaacgatattaaaaactctcacagacattttttttctcccaagaggattacattattgagaaatgtaaggggccttaacacttgccggaataattaatattttgtccgtcatctatctaagatgagttgtctcgaacagttctgtatctcatgtggctttagtttgatcttagaatactggcttagaaacctagggatagcatggtctggataaaaaggaaggtctgtaacaatgattgaggctattggtctatattgcaaaacattttgcacatttgtactttttaaagtttctcttttttattttacattgatgctaataaaaaggcttttaaaaaatttaccattatgttctaataaaagtccttgctttgatttggaaaggctaagttatgagacagccacataattttcattaatatcaatcatgtgtacaaatattttagcatgaattcttaaaagcttaccacgatttgagcacagttttgttgactgatgctttcaactttcaaggcagaagatattcaaaagtagcaaataccctctccagacttttttctctgaatgtgaaaagcctataattagcaagtattttgtcacttggtaagggaaatgcttcagagataaacaactcatggactgtgaaacactgtagcagaattccaaacatttagatttggaagttttttattcattcgatatttgagtgcctgttaacgtgaatatgcagtgctgaattggacagattttactctaatggaattaagaatctggaagagaagacagacattacatttatgattatagataggatatactgtaggtaaggagaagtgttgaattttctgaatgtttatatcaaagtaatttaggtcaagattatgattcacaaaatgtggttctcagacaagtagcattaacatcatcaggaagcttcttagaagtgcaaattctaggctccacccaagacatactgagtcagaaatactggggatggaactcagcaatctgtgatttaatgttttctaggtggtgctcattgctcaagattgagaatagctgttctaggtcagagtttctcaacttgagcactattgatatttgggccagaaaattctttgttacaggagtctgtttcgtgcattgcagtttgtttagcagcattcctggcctctaaccattagatgccagtagcatcccccagtagtgacagccaaagatgacaccagaaattgccaaatatctccagaaggcaaattcttattagcagttccctgcttcccctcccccacattgccccaggcaatactcaaatgacttgccctgccttttatcttatcctatagtgtgtggtaaggtgctctgaaacaggacaaaggaattccaccatgtttattcattatgaaagaagtaaatttgagcccaagaccagagatggtccaagttctggtcattttagtctttcattttttgccttgttttcaacctatttttcttctcacttcaataaatactcttatatattaatcctgttttatccttaaatagtaacacattctgtttatgttctaaacttagtgatttgatgaatctcatgtaattaacatgacggttagactcaggcacctgcactttccaaagatctttgaacataattaagaaagtgaagggcataattttaatagtaaatcaaaatattctcattgatgaattatgttataataagtctctgtcaatcacagattctcttgggaatttgtttctttccaagaagtgctgagtctttctctgtagttactcatctattatatttcaaaagtgtttctgaatccatggttatgaagtaggaatatccagtttcttatctgtctgttaaccaagttccaaagtgttttagttttctgggttttagactataggtggtcctgtttgagattgctaagacccaagtagataagagtagttgcatttaaaaagcagagattactgcaagtatagaagtaatgcattttggtaggtttgcaaacatatgtacactttctaaaatgtctagatagctgtgtacctatggaattttttcacaggttagttttgctggtaggcctataacaagattcaattatcattaatatttggctcacattagctaactcataagggtcagtgatatggtttggctctatgtccccacccaaatttcatctcaaagtgtaatccccgtgtgtcaagggaggcacctagtgggaggtgattggatcatgagggaaattcccccatgctgttcttatgatagtgagttcttatgagatctgatggttttataagtgtggttaccctgctctctctctctttcctgtcaccttttgaagaaggtacttgcttctcctttgccttctgccataattgtaagtttcctgaggcctcctcagccatgcagaactgtgagtcaattaaatctctttcctttatgaattacacagtcttgggtatgtctttataggagtgtgaaaacagactaatataagaaatttgtaccagaagtggggtactgctataaagataacatgaaaatgtggaagcaactttggaactgggtgacaggcagaggttggaacagttgggagggctcagaagaagacaggaagatatggaaaaatttggaactttctagagacttgttgaacagttttgaccaaaatggtgatagtgatgtggacaatgaagtccaggctgaggtgatcttagatgaacagtttcctcagagatgaggaacctattgagaactggggcagaggtcactcttgctatgctttagcaaagatactggtggagttttgtccctgccctagagatctgtagaactttgaacttgaaagagatgattttgggtatctggtggaagaaatttctaagcggcaaagcattcaagaggtgacagagcataaaagtttagaaaatttgcagcctgaccatgtggtagaaaagaaaaacccattttatggggagaaattcaagctagctgcagaaatttgcataagtaatgaggagctgaatgttaatagcgaagacaatgaggaaaatgtcttcagagcctgtcagacctccatggaagctcctttcatcacaggcctggaggtctaggagggaaaaatggttttgtaagatgggcccaggaccccactgctctgtgcaccactgggacttggtgtcctgcggcccagctgcgggtctaggaggtctaggagggaaaaatggttttgtaagatgggcccaggatctcactgctctgtgcaccactgggacttggtgtcctgtagcccagctgctccagctccagccatggatgataagggccaaggtacaactcaggctgttgcttcagagggtgcaagcgccaagccttggtggcttccatgtgaagttgaggctgccagtgtgcagaagacaagaattgaggtttggcaacatttgcctagattttagagcatgtatgaaaatacctggatgtctaggtagaagtttgctgcaggggcagaaccctcatggaaaacctctgctagggaaatgtggaagggaaatgtggatttggagcccacacacagagtccccactggggcacttcccagtagagctgtgagaagagggccactgtcctccagaccccagaatggcagatccatgtgtaagaattaaagaaagaagaaagaaacatgaaaagcagctcaacagtcaaagacacttttattttttaatataaacctgagagggacttctgaccgatttcagtcaggagcactctctcttacagactaagagtatttaaggattcagggtgggaaagcttatcacaggctcggaatgtttctgtgtctctttgtcttgcttctctgggagagagactttttgtgtctatttccatatatcttcctgaagctgcaggcatacccgtctgagttgcttttacctttcctatcttagtgcacctaaagggaaagggatgtgcttattaggtccactattttactggggcccattgtattagtgtgaagtttggcgattaccaacacaccttcccccttccttctgtgcctgagctgccttatctgtgttttactgtctgctcattctggctgcttgttgttaaaagagaagtgatttccttgaaatgcacgaggttagaaagggagctggaacttaaaacagtggtatttgaccaggatgacagtgctcttgctctatcaccatgaacagcttgtaatgtgcacctggaaaagctacaggcactcaacaccaacccatgagaacagacgcgggggtggaacactgcaaagccacagtggtggatctgcccaaggccatgtgaatacaccatttgcattagtgtgtcctggatgtgagacatggaatcaaaggagctttaagatttaatgactgcccccactggattttggactaggatgggggcctgtagcccctttactttggccaatttctcccatttgaaatggggacatttaccaaatgcctgtacccccattgtatcttggaagtaactaactggtttttgattttacatgctcataggcggaagggacttgctctgtctcagatgagactttggatttcagacttttgggttactgctggaatgagttaagactttcagggactgttgggaaggcatgattaaaatatgaaaagggcatgagatttgggaggggctaggggtggaatgatatggtttgtccctgtgttcctacccaaatctcatctcaaatataatccccatgtgtcaagggagggacctggtggtaggtgattggatcatgggtacggttcctcccatgctgctcttgtgatagtgagagagttctcataggatctgatggttttataagttgtggtgtcccctgctctcttggtctttcctgctgccttttgaaccaaagggacttgcttctcctcatcttctgccatgattgtaagtttcttgagatctcctcagccatgcagaactctgcgtcaattaaacctctttcctttgtaaattacccagtctcaggcatttctttatggcagtgtgaaaatgggctattatagtcagtgagggtcaagcatgttttatctcaaccaacaacagattcttgggtaggatggcagtaatgcagtttgataccaaaaggtgatggataggatgatgatgataataaataatatgtaataagaacaaattttagaaggatatgtttcaaagagtacagaagtttgttagacctgactggtattggatagacataacattgtttaagttcgacagaaggagaagatccaccctgtgtggggaacaatgagaacaggtctgaggtacagtgaatgagattgttgatttatgggaacggtgaagttttggaaaatacacagaatgagatgtggcatacttgaaagattctattccagggaaaacatacacacactggaaaatggagatctcccttagagactcgggatagagaaagaagcagctaaaaagaattgggttctatcagaataaaataccaccagtcaataagaagataatcaattaaaaacaggctaatgacaaacactaccataagatgataacaaaagtctacctgcattaaataaactgcacaattgtactttaatgtagcgggaggtagaacatgtacccttgaactaaagctaaagccaagtgagccccctcctcccttgagtatcatctgctagtatgggagaaaaataattcaagacataatcctgatcataaggaaaatagaatccaatgtttgtaaaacttgctatataaagaaaagtattgcttactattgctggacaagaaaaattcaagatatgaaattctgatcattaaaaaggatcccaaaatttattaaaatattatgtgtaatgaaaagataataaatatttattgaatgaattcctcaattttcctatgaattgagaagtgctcatgaaaatgcataggtaaattataaaatgctattccatttcattcagggctctgctgagctgaaataccacagagatccctttccagactgaattgtttgaaaaagttctccctatcactttcttcatagcacatatcatttgaggttttactatttttctgtccttcactagagaataagcaccatgtggtcagtgagttcatttgttttaacttgtggtctctcatacctagaatagttctggccaaatagaagacactcaataaatatttgttgaatgaataaatgaataaaaaaacttcattaaatattttgaagggattttcatataaaagaaaaagaaatgctgaacttttcagcaaagtaacccatgtatttgagataaaattaactcctccactttaagtttgatttacgcaaaaaaattgtacatttttaaactataattgtaacctgataaatatattttctaaataagttaataaattttggaaaacatttgatgcaagatatactgtgagagagccatgagatctggccagttgaccatgttactattggaaatgttaataaaacagtaagattgctgatgttgctttccattagaaaaaaatatcagagaaacatatgctaaggggataaacaaaaatgaggagtctagagtctacttgatcttagttattgagacaattctattaacaagagagtggggggccaatataatgtggtctattaacaagagagttaaggatcaatataatgtggtccttaactatatccttacataatttgacacatgaatgtgcaacatagtaaagcattagtgactttatcatgatgagcatcagatttaggatcctgtaatgaacacatcccagtctctcttctagctaaatattgaagtcagaatggagagattgcatcctttggaggcttgacggagactttgattgccatttggccttaagctccatatcaagctaacatgaattagaaaattattcccacactgctgtaaaggtgaagccatagactccatgtcagatcctcggcacatatgtaattgagtttgtgccataaatagcaaggtagtacagaagttacgtgaaaattagtctgtactatagttacaaatatgtatagtaaaaattgtgattaaattcagggcattttaaacttgagttgtccttttattattcggagacaaatatagtaaaatctagaggagtggttttaccccaaaagcccaagaattattcatcagcagaacaaaggcataaattgaggcctcttgaatcccaatccttttgtactctttaatacaggtactcttggatttatggtgagtttatgtcccaattagcccatcataagttgagaatatcataagtcaaaaatgcgttaaatactcccaacctaccaaacattatagcttagtctagcctgtcttcagtgtgctcagagtacttacattagactgtagttgggcaaaatcacctaacacaaagcctattttataataaggtgttgaatatctcatgactgcatgtcactgcctggaaaaagataaaaattcaaaattcacagtacattgaaattgtgatggttttatatcatcgcacagtggaaaaattactaacttgaaccagcataagttgaagaccatctgtatatgacacttacctgcagagaatcatctggattctaactgaataaagccctcaactgagatttttttattgcgaaactttgatttgaaacacagtgaataaacatcaaaatataaggtacaaagatacaagtcaatactttgaatataagaaaagcaacctttgacaataagattccaagaccaggatagtcaacattactctttcatcgtgactttaggatgaccaaggcaggcacaatgaagataaaatatggcatatccttgttcttcttcagagccatgagtatttgctttttgtttaaaggtgtttttagcagcttgaagaagctgctaaaccattttttgactctgaatgttcaggaaactatgttgagctctgaagatgcaataatttttaagttatctacatatatctctctctttcttaccaaccatacatctgtgcaccatgttagattttatttgttatgattctcaaaataggagataatgaaaatattaacagactgctgtttagtttataaaatgctgtttttcagttaatattaaattctgaacaatatgactagtattcttatggttgtcttactcatgaggaatctgaggctcatagattgtaatttgacacaaattacaaaccttctaaatggaaaagcacaagatagggatttctgactccaaagccagtgtttgtttgtttgttttcttactgtgttgcttgtagcatctacttacaggcattattattattgcttaaaaaatcttgccatctgtttacattgacttaccactttagaaaccatttgctaaaaagttgacagtataataaaagtattccattattaaggatgaataattagaactagatgtgaaaggtgaaagggtagagtttaaatacatataatttattatttaagaaacttctaataaagaagattcttttacaatatgactgactataccttccaaaatttcagtgaatgttattaaatcagcatcctcaaagatttcatgtctgccaagtgttgcagacaaaaataaaactctttgaaagcatcttgccaattgtctctagctcctttatgtgatgaaatgtttgtagatttattataaaatcataatttccattttagtattttcataatactatatttgatagaagtcacttaattaaaagtgttgtcaagggaagtcagctgaaaattaagaaagcacagacagctgcctctgttgctaccatgaaatttatgtcttttaagaagtactttattctcattcaacaatgtttgcatgttggttaatttcaaatgtatctttcaaatttatgaatgtataatttttattaaacaaaaacattataaaaattaacgcataaaagtgaaatactcatgtttttatacagttaaatttagaataaatgtaagttttttgaaggaacaaagtatcgtttgtataggagagaaagaatgtgtgtatgtgtttgtgtgtgtgtgtgtgtctgtgtctgtgtatctgtgtttatagaggtggtgaaaatttattaaatccccccaaaatggaactggatatgacattatagtgtatttggtctacctagaccaccttacttgtcaacagatgggagccaggagactttaaataagtatcttaaggtcacatagtatgttagtagcagagcagaactagaacagattttctcattctcagttatcttttctcattactcttcttcttctttagttttatttgttatttgtgataatttacagtgcatttgtgaattgacatgcctatgagacttctgttggcctactttgcttaatcctaagagggctattacatgaggacatctgaattgagaaaggcaggaaaatgtatttaggtgtgacattaatttgtgacctatgaaagtgctgtagcatgcccccatatctaggccttcagtttaaacaaattggttaaataggggctgtggctcccacactctctaattcctaaggcttttctctcccatcccaatgtaagtcaatgctgattgaacctcgttcacttaggagtgtccttgtgactgccttctgggtataaatgctcaagataatgatgacacgtatggtaactgtattctcctgtattctgagagatgaaagtgaactgtgattctgcttgcaaggtatctgtgcctgcttgtattcttccccagcatttcccagtctttctgacttttccatagatcttcatcatttccatagacatttgtcttccttctttttttaacttttacatgtcatatgggagtggcccctgtaagtatcatttgttcttacccaactttctctatgacataagaaaccttttaaatactgatcaaaataattcaggcaatgttctttaataatataaaatataagtattgtgtttcagatgaatcagacatattcgtttagtaggtcagattctccatatcattatagtgatgagcatatagtaggatttatggaaatacttcacttacatttcccttatggagatgacaatagtaagaatttttactttttttcttacctttcactacgtaaggatgagcttggattatttattttaaaatccataattaggcatttccaactacttaatatggtttatataaacttactaggaatatctgttgaattaaaaccttaccttatgtttgattttaaatgtacctgtcttaatccttaaaataagaagggtacatttttttcaattactcctcacttaagaaaagatattcttgagtagttatttataataaggagatcatggactacttacattttaactcaaattcttcttaagtgtttacatttttaaatattgattattgctagaaggaactcatacattaaattggcatactctttttttattcttttcttgccttattttcaattattctataaattagaaaattttttttcttagaataaacaaaatcacagtgttctgagattttgcaaagtctatgtcactgaataacagtgaatatgatttttccttatgaatgagaatattttctctggcaaaaatagaattaaattagaaatcaactacacaaataaatttgggaaaccctgaagtatttggaaatttatgaatatatttctaaaagaggtcacaagaaattgtaaaatattttggactgaatgaagactaaaatccaacatttcaacatttatagaatgcaactaaaacggtagttttgggggaatttatagttttaaatgtctattttagggaagaataatattctcaaattaatatccctagcttaatcttaagaaacttaacaacagaaaagcaaagttattcaaagcaaacagaaggaagaaaataataaagattaagatggaaatatacccaaaagttaattctttaaaaagaccaacaaaactgacaaaatcttacctagatttactacaaacatgagggaaaacacaaattaccaagactgacaatgaaagagatgacatcattaggaccctaaagacattttaatatattataaaaatgttattataataatttagataactagcaaaaatggataaagtcatggaaggacccaaattaccaaagtggggtcaatgagaatttgagagtatgaataaaactataaaattgaattagcaatttaatatcttctctaaaataaaagccctctatctcatggccttattcaaaattctgtgaaatatttaaagaagaaatagtagtaatctttcctactggtaccagtaggaaccataaaaatgtattttattaataggctagtgtaatcctaattctcatatcagacaaatgcatcacaaggaaacacaaccaaacagataaataaacaacaaaaactacagactaatatttttcataaatgtagaggcggaagtctttaacaaaatattaacaaactaaattcaagaacatataaaaagcattatacactgtgaccatgtaggatatattccagacagtcaaggttggtttgtcatctaaaagtcaaataaggtaatacattatattaacagaataaagtaaaaagcaacacagtgaactcaatatacagaaaaaaattgaaaaattctaatagtcatgataaaaactctcaaaaaactagtaataaaagggaatatctttaaaatgacaaacagtatttagttcacagcggatataatacttaatggtagagaatgttaatttaatatttctattaaaatctgaaatgaggcaagaatgtctgttctcatcacttctattcaacatagtactgaaagatctagccagtgcattaaaaaggaaaaaaaagcaattaacagcactcaaattgaaagagaaatgtacaattattttacttctcagatgacatgatcctttatgcagaaaatacaaagagatccataataaactacttgaactaataaacaaatttaccaatgtcataggatacaagattaatataattgtatttctgtgtactttcaaggagcaatctaaaaatgaaattatagaaaaattatatccatgacatcagaaataagatacacaaaaaaattaagaatataatgtaaatgtaagtataatatatattaatatagcataattataatgaatatgaaataaatataaatatgtaaaataacatcacaaactaagaatataaataaaaaagattaaaaaatctgtgttaaaaactacaaaatgttgctaaaacaaattgaagatctatataaatggagagacattccatgttcatgaattgtaagtctccatactgtgaagatggcaattctcccaaaattgatctatacattgaatgcaatttctatcaaaattctaagtaggctttttttggaggtagaaattgatgagctggtttagaaatttatgtgaaaatgttaaggacctaaaacagccatgacaatatttaaaaataagaaaatggccatactgcccaaattgatttatagattcaatcctaccccaatcaaactactgttgactttcttcacagaattggaaaaaactattttaaatttcatatggaaccaaaaaagagctcacatagccaagacaatcctaagcaaaaagaacaaagctggaggcatcatgctacctgactttaaactacaccgcaaggctacagtaaccaaaacagcatggtactggtaccaaaacagatatatagaccaatggaacaaaacagaggcctcagagacaacaccacacatctacaaccatctgatctttgacaaacctgacaaaaacaagcaatggggaaagaattccctatttaataaatggtgttgggaaaactgtctagccatatgtagaaagctgaaagtggatcacttcctttcaccttatacaaaaattaactcaagatggattaaagacttaaacataagactaaaaaccataaaaaccctagaagaaaacctaggcaataccattcaggacataggcatgggcaaagacttcatgactaaaacactaaaagcaatggcaacaaaagccacaattgacaaatgggatctaactaaactaaagagtttctgcacagcaaaagaaactaccatcagagtgaacaggcagcctacagaatgggagaaaatttttgcaatctatccatctgacaaagggctaatatccaaaatctacaaagaacttaaatttacaagaaaaaaacaaccccatcaaaaagtgggtgaagaaaatgaacagactcttctcaaaagaagatcattatgtacccatcaaacatatgaaaaaaagctcatcatcacttttcattagagaaatgcaaatcaaaaccacaattatatatcatctcacgccagttagaatggcaatcaataaaaagtcaggaaacaacagatgctggagaggatgtggagaaataggaatgcttttacgctgttggtgggactgtaaattagttaaaccattgtggaagacagtgtggtgattcctcaaggatctagaactagaaataccatttgacccagcaatcccattattgggtatatacccaaataattataaatcattttactataaagatacatgcacacatatgtttattgtggcactattcacaatagcaaagtcttggaaccagcccaaatgcccatcaatgatagactggataaagaaaatctggcccatatacaccatggaatactatgcagccataaaaaacgatgagttcctgtcctttggagggacatggatgaagctggaaaccatcattctcagcaaactaacacaagaacagaaaaccaaacaccacatgctctcactcataagtgggagctaaacaatgagaacacatggtgaacagtaaggggaacatcatacaccgggacctgtcagtgggtgaggagctaggggagggatagcattaggagtataggagtaatacctaatgtaaatgatgggttgatgggtgcagcaaaccaccatggcacatctatacctgtgtaacaaacctgcacattctgcacacgtaccccagaacttaaagtataataataaaaacaaaaaagaaattggaggaattgccatacccgatttcaaaacttactataatgttacagtagccaagaaaatgtggtactatcataatgacaaaaatataaatcagtgaaatagaattgaaagtcaagaaataagcccttaggtttatggccaattaatttaaaaaaatagcaaggcaattcaatgaaggaaagaatagtattttcaacaaatggtgataggaaaattatatatccacttgaaaaaaaatgaatttagaccctgataccacaatagaaaaaaaattcagaatatagaagaccttaatgttagcactaacactataaaactttttagaaaaagactaccagataatcttttaccttgatttagacaaatattcttaaatgtgatatcaagagcatcattcataaaagtgaaaattaataaacttgacttattgctaagagaatgaaaagtcagggagaatgaatttgcaaaccttatattttatgaagatcttatatctaaaatgtattttaaaaaatcaaaacaaatcaggcgagagattttaacaaattttttaccaaagaattcatgtgattgggtaatacatacatggaaaggtgctcaccatcattatctttcaggaagtgcaaattaaaaacataatgaaatacctctatatatctacaagaatacctataatcaaaacggcaacattggcaaaatgcggagagactagaacctttatgcattgctggtggaaatacaacacttggggagacaacgtgacagtttcctaaaaagtaaaatgtgtacttattacataacccagtaattccactgttatttatatgccaatgcaaaacgagacatacagctatgcaaaatcttgtacaggaatgtttatgacaacattctttatatacttaaacactgcaaacaatacagaattctattaactagtaagtggataaaaatgtatatatatacagtggaatatgaatgattaacagtaaaaagaacaaactcctgtggctactataagatggataagtcctgaaaacattatgctgattaaaagaagcatatgtactgcgtattgtatgattccattcaaatgaaaagtccagaaaagccaaattttctagagacaaagagcagattgcctggtgattgaattttacctatacaatggctaaatttttaagatatgaacattacacccccaaaatgagagacatggaaggagtaatcagagccatttccagatgtaatctcagcctcttaccatagggatgatatggactggaggaaattctcaagaatgtgattattttaattatgatgggaacaaggtaactataaagaatagaaaacaaacattttagagataagccctgattccatttctgtattgaatttacagataattgtttagacactacttttgatcgaaataacatatataagctatttagacttaaaagaaaaagacatgtagaaagtttcctctagttgaacaaaaccttcaactgctttctgtattcctattttgactctcgaaaagaaagaaaatgaaaaggcaaacaatgggtgaagagcttttattcaactacattcttttacctgatatgttttaggttcaataaaagccaattttatgagtttgtggatatatatacacacacacatatatacgtattgagcattgcttgaatattgagacttttggaatgatcaggtatagtaaaataaactctgatatagaggactagaaagaaaaatgactttttaaaaataaaacaggtgcatttgtactttgaatgtacagtgtatgtgtcacatgtttatatgtgatacttatgcacattacttatatacgtatttaatgttaaacatgtaaaatatacacactaagagtacatgttttgtttatattttgctaggttctcatttaatcacaaggaatattaacctaattaaggcacaacattttctttttgccatattctaacagcaaagataaagagacactccagtgtcatgttatatgtatgacagatgcttacagtcaacaattgccactgcaaacagcattggttagcaactgtattaaacttagacgtactgttggtgatttgggtggacttaacagttgtcaaaatttggggtaagtcagttttcatcttgtgagtttgatttttttttttttttagtctgggtcatgctctgttgcccaggctggagtgcagtggcacaatgtggtctcactgcaaccaccacctcccttgttcaagtgattcgtctgcctcagcctcccaagtagctggaattacaggcacgtgccaccacgcccggctaatttttgtatttttaatagagctgtagtttcaccacattggccagggtggtctcgaactcttgacctcaggtgatccacccacctcagcctcccaaagtgctgggattacaggcatgagctaccacgcccggctgtgagtttgattttaatataaagttttctaaccacatgaaagagtttctattgttttgattaccatggctataattgatctcaatttttttcatgcaggcaatattagcattgtgatacataaaatatatactcaatttaattctttgggagtgaccaccagctctctccttaactgactactctctagggataaaaaagcaatttgaggaaatttgggccatgtaaagatattgtaaacatcaaaattgtgagaaacaaaaactaaatataatatgaattcaaattgtgtgtgtatattcacataaaatctgtccaacttccaacagttgaatgactggaattatttctaacttctgagatttgatattggttctatgactaaagaacaagctggaaaggactaccatgttattagaccacccataggtaaaattattttcaaggcttacatagtaaaacatatattttatatatatatatacacacacacacctttgtttgcattattatactagatattgtggctataaaacagaatagaatatgaaatttgtcctcaaggatgtaaaagtacatttatctttttctttcttctcagaacattgtaataaatgtagtacattttcctctgtagaattagtaaccatagtattcatttgaatattcagtggtaatgtgagtttcaatttttagctttataggtactttctagtgactgatataataggtttcagaggcccattaactctacctggtgtccacataagtaatcacatactctgttgtatgaatggcttacatttttcataacgacctgcaaatataaaacctttctttctctccctattagttattctctcttggcacgtaagtagaagagacataatgaaataccaggagttttatctatttgaactcaagtaatatctcccaaggtgacattcccatgggtaaaaaagcagtcttcttcatttttgtgttttaaaacacttatttagatctagacttaagtgttgcttttcttgtaggagtttgaaaatgcttaacagtctaaagttaattattactctttacaaatatattcaagtttctcaagttatctaactggctattcttcctggctggttgcctgtagattttcttagaaaatttgctactttgacagggtagagttacatgatattgtccctactgttgtattctggatgtctctcatgctgccctatcagaatcccgagaaatggcataggaagatcactggagggtacactgagcataaattgatctggctactgccaggtcttgagaatgagaagagggaagagttgctgtgtatgttgagcaattaaagtactatcaaatgaatctgatcacaacatattgcctggaaatatgctatattgctatggcaaagtctattttgtatatgagattgattgttccacatgagggcaggaacttgtctttcataatgagtcagagaagtgacaatttctcgttatatttcagagttatgggggattgactatagtgtgtattctgcagatatgcctcaaagataaaaataaattaaatgcaatggaaacgtgttgatgaatttaaaaagttgttatttaacctattggtatttattagctcccctgtggcttctatgttgagaataaaaagatgaataaaacaagtttacactaatatcttgtcatctcaaacgctcaaaatagtcagtcttaaatgactgatttgatgcttttttttttagtaaaatttaaaacctagtgactaaaagggcattctttggagtggcagagatgttctatgttttgattgtgatggtggttatatgcttgtatatatttgtctattaaattttccattaaatactgttaacatgggtagattttgttatatgaaaatttgactcaaagtaagttgatgttggtcaaaaggtgcagtttcagttacacaggatgaataagttctgaagatctttcatacaacatggtgactatagttaaccgatatcatattttatacttaaagactgctaaaaagaatagattttaaatgttctcaccacacttataagcaaaaactggtaactctgtgaagtaatggatgtcttaaccagtttgattgtagtaatcatttcacaatatacaggcacatcaaaacatattgtacaccataaatatatacattttttccaactatacctcaataaggattagaaaataaataaaaatggtttattttctctctcattatataatagatgataatgtgtaccagtactgctggtaaaagtattataaataatatttgctaatatatattaatgcagttacagattattttccctttgttccgatgttctgattgtggaataattactgagtatagagttaattccaggcttgctctttctctctgtttctttcttctctttcactcacataaactaaaggcataatttaataaatgccctttcgtgtggacctttggaatgtcttttattccattaaaacttagagaaattgaatggtattttaggcctttaacacattgtttaatttactattttcttctaaagaattgggatttcaacaatccaaaggtgcctcaagcttaacatgttcaaaattgaactccctgttgttcctcactaacttgtatcttctgctctccaaacttctgtgaatgataccgtcacttaccagtcacacaagacagaggtctagaattcctctatgcctcccttttcctggtcctttccctatgaactgtattccagtcccatcagtccacctccttgacacttcctggatccattcccctggagttactgttgtgcttccatcttaattcaggctccatttatcttttacctggcctactgcttttctacaattaatacttctgcagcagcaaggtgatcactacagtgtcaaattggttatgtgaactcctaaagtttaatcttttactaatttcccatttcctaaaaggttagaatccaaattccttggtatgacacacctccatggtatgacatggaggacaaggtcctccatgatatgaagcctatccacctcttcaatagcaattatagaacccgaccatatttaataagtttatttaatattgaatacagaatccgaaaccgtaataggttgtctcacacatatataaaataaaagtattataaagaatatttgctaatgtatatttatgcagttagtgattattttccctttgctctgatgttttttgtttttgttcctgcttttgtttgagagagtttcactctgtcacccagtctggagtgcagtggcacgatctcagctcactgcaacctctgcctcccaggctcaagcaaccctcccacctcagcctccccagtagctgtgactagaagcacatgccaccatgcccggctaattgttttgtatttttagtagagttggggttttgttatgttgcccaggctgctcaaacttctgagctcaggcaatctgcttgtctcagcctccgaaagtgctgggattaaaggtgttagctgctgcgcccagcctataatttttaattaatttattttctctatctggaataaccttacacaaaaagggtcatctagtgaaatagctactctgtgccagtgtcaactgcatttggaaattactcatattcctctgagggataaatgaccaactcttccttataccactacagcatcctatttctatacatgcattactttgtaagttctttgcagagcatttccataactgattcagctctgagattcctataccacacctggcatctgacacatggtaaacaccaaatccttgacaagttactgactactatttatattttatgtgatttatttaagctgaactaattatgatgctttcaaaatttaaatgtgtatagttttaacatcaatgaaatccagaagagatagttgaaggaaaggtttctgaggtttttaggatggaaggaagcataggtaaaagatcataaaactgtcagcagctttttaaatatatagagtgttacataaacacatatctgtccataagtagtgatgccataaaattgtctatccttcacctcaaatacacaaagtgtaatttattttttctttaatggatttggtcttccttatgtgatgagtattgggatatcatactttattttggtccatttgcgtctaatctcacattagtctataatgctgtagattcaagtatccctttaggcagtgctgactttcttggttaaaaatcctgtctctcaaccagtacctctctacctccttaccctaaagtggcatctgagggaagggttgacttcctaacctcttagtgctgagataagatccctgcattgtgatgccctgcgacaaatgtgaattccttttctttttttctcctatattcctgcagttgctggtctctctgttggtcataatggctgagctcctaaactgtttgagtccagagtggcatatttcttgtgtgtccagtagagactggtggtcctctcttgcctacccaagctcttcgtggctcatgatggtgacataggctctctgaatcacggcttcaattgttatagggtcctcactgttcaacctccaggccactttgccggtccaactctactctagattaccctgaaatgattcaaatgataccatgtgtctgtttccattagtgaagggtgatgtgatagagcagtcccagtcataatgtctttggagctagaacaagaatataaatggagattattagttttacattaaatatttaactcatgaatcaatctgacagtttgttaaaaatatatgctatccttctaccttgacaaaaatatcttcttaatggtctggagagccagatttgaattgagaatcatctgactccttaaagttctgcagccaaaaaaaaacacaaacaaaacaaaacaaacaaacaaaaaaaacagcggtacaggagaactagcacctgacacctgccctgtgtctaacactaggttttttttcacccctgaggctgttagcatcttgagagcttcaaacaaacatgtgtgaatgccccagcctgtatgttgaaactgtttacacatgctactcctcaggcccagagatgcccatataggtggctcaattcattgcaaagaggaaaaacccagggaatgaactctcacagaccagggcagagggcttggagaggaatgttcagagtcctgggtagggatggattccagacaggtataatatcaataggtaattatggcctccccttggccttatggaatccttgccacatgagtaggagtgagctagaggagggagagagaaccctccaacgtgcagagactgggtgtccttgatctaaggttcatacttactcagttcacagttagatttccataatctcaagtctaaaaggctcctatctaccaacgtcctttcttaaggtcttctgtttaattataccatggtctcgttctccttttatattcttaaaaagaacaagtcactaacacagtctgcctgggaacagtacactttttggtaacatcttagagcagaaaatatatttaaaaagcaacaatataaagaggaaattaattttctttttgtttcctaagtattacttaatacttacaatatatttttcctattacttatataggtattgccatcgacactttgtaagttgtagtaatacacactcataaattcagcagttaactcctctagctttgcacgtaatgctgttatttcttttaaaacacacggttatcctattacgcatgtgaagcttggaataaaatatatattaaaatatgactaaaaataaaaacagattttataggctttggaagtactatactttaaaagatctatatttttcacactgaggaaggagaactactgaaataaagtgtactgtgtcaaagtattacacacagaatatgagaatggcaatattgaatatccttgcccaactgtggaaaattaaggattaagatttgaggaaagtctaaatgcgttaaaatggaaaatgtaggccaggcatggtggctcacgcctgtaatcccagtactttgggaggccaaggcaggtgtatcacctgaggtcaggagttcatgaacagcctggccaacatggtgaaaccctggctctactaaaaatacaaaaattagccaggggtggtggcgcatatctgtagtccagctactcgggaggctgagacaggagaatcacttgaacccataaggcagaggttgcagtgagccaagatcgtgccactgcactccagcctgggtgacagagtgaggcttcatctcaaaaaataataaaaataaaataaattgaaaataataagcacaacattttgtcatttagttgataaatctacagtttagagtttgccatgagtcaaacactatcgtttcccaagtgaattaactttcataataatttgcctttttaaaaatgataattacccattccataatgggtaattacaggtaactatattttaaaagaactcactattactgtttatgtatctactgatttgaaagtgaaaatgtaaaaatgtttttatcaacatcaccaagatgtttttctacaaattctaactgaattgtattctactctataaactgatagacctttgctttagaaacttatgtggaaataccaatccagagaaatcctgtctccctatctcccacctgggactctttagaacctttagtattcacttcaaaacgtctgatatgggaattatagtgtggtgttctttaacttttaatatcacagatcccataatttggagcatcatgtaacattttgtagagctactattcctcagaacacaatttgagaaatgttctaatagagtcattttccacaaataggaaagtcctacaaatattattatactaaatcataatgaaaactagtctgatttgatgtattaattataaagtagtttagattactttaacttttggtgattattgccaaaacttctttcctattaagagtattctacaataaattaaatttagtccacatataatgctgatcatatgtacagtaacattaacatctaagatgacagagtaatatacatcttattacttttgtgaaaaatagaaagggttacataataaaatattaattgtctagaatttggctttctagaggcttgatatactgtgatgtagcccttaaaatatggatgttcttgtcagaaatgtagttctatattgggttctacttttgttgtcagtatgactgggacaggttactggatctctttaggtttgtttactcacaggtaaaatggtggttaataatatcttcctggaagagttgtgatactaaagagatggcctatatatgtaaaccacctggcacctggtagaagcattgattactcttctaccattcattttctttgaattcaattttttttgaggaagtacttcttggtgacagtgaagttccttaaccctcaagaaaaagagaaaactcagattcttggaggaaagaatgtagcactctcttttaccttgttataaaaggttaaattttcccttcagaaatttggaaggcgtggggaaaatttaagggagcaataaagaagaaaagcagaaatctgaacatagatgacaataaaaagaaatgataaatacatgcatgtacactcatgcatgtttgcacacacacatgcacatgtgtacacatgcccaacaaccacaaacacatccacaaataaaacaagagacactggccaggggcagtggctcacgtctgtaatcccagcactttgggaggctgaggcggacagatcatgaggtcaggagttcgagaccagcctggtcaagagaccagcctggccaatatggtgaaaccccatctctactaaaaatacgaaaattagctgggtgtggtggtgggcacttgtaatcccagctactcaggaggctgaggcaggagaattgctttaacccgggaggcagaggttgcagtgagccgagatcacaccattgcactccagcctaggtgccaaaacgagactctgactcaaagaaaaaaaaaagagacactgaaaaaaagagaaaattaactgtgatgctcactattcctgtgaggttgatttaactgctacctgcactgcaatttaatatgatgaacttaagagtacaaggcatctggaattaatctgaaaaattattattagaataatgacacttgaagtgttgacttttgactacaatggaatatttattaactagaacattctgcatacaggcaggaccttgtgaagcaaaatttatagctttgtgttcaggaatgattacaaacaaagatagcagaatcagggctttattagagtactatgcaacagttttgctaaatatatgttaaaggaatctgaaagaataaagagaatcatgaagattatcctaaggattctcctaaggaaattgagctttctgtgctacccagagaagggcccagatggtactggattcccgctgtaacttaaagggaagcttttacaatgtctggaacctgcgatgtcttgaaaatgaaggtagaggatgtcctcaagtttcttacagcaggaacccacttaggtggcaccaaccttgacttctaaatggatcagtacatctggaaaaggaaaagtgatggcatctatatcctaaatctgaagaggactcaggagaagcttctgctgaccgctcgtgtcattgttgccattgaaaactgatgtcagtgtcatgtcctccaggaatactggccagagggctctgccaaagtttgctgctgccactggagcaactccaattgctggctgcttcactcttgggatgttcactaaccagatcctggcagcctttcaggagccacagcttctagtggttaataatcccagggctggccactgtcctctcacagaggcatcttttattaacctgcttactattgctctgtgttacacagattctcctctgtgctatgtggacattgccatcccactcaacaaaggagctcactcagtggggctaatgtggttgatggtggcccggggagttctgcacttgtgtggcaccatctcccatgaacatccatgggaggtcatgcctgatctctacttctacagagatcctgaaggattaaaaaggaagagcaggctgctactgaaaaagctatgaccaaggaagaagaatttcaggatgaatggcctactgtagctcctgagtttgctgctactcaggctgaagttgcagactggtctcaaggtgtgcaggtgccctctgtgcttattcagcagggctctgctgaagactggagcactcaagactgccacagaagactggtcttcaactcccacttctcaggccactgaatgggtaggaacaaccgctgagtggtcttaagctgttctttcatagatactttttttttttttttcctcctgagacggagtatcaccctgttgcccaggctggagtgcagtggtgcgatagctgactacaacatccacctcctgagtagctgggattacaggcgtgcaccaccatgcccggctaattttttgtgtctttagtagagatggggttacaccatgttggccaggctggtctcgaggttcttaagctacatggcaataaggttgttggaaaataaacattattgtctaaagaaaataggaaagtgaaatataaagttatgaatttaaagctatttagaagggcatgaagaaagaccaaagaagtattcaaactgaaattattctaaaatgaaatttcaaattaaatttaatctagtttcacattgctgattaaattttagatgacactgtacaaagctatctgggagagtgaaaccacatgacaaatttactggttgtcattttctactttgtgattttagcctataatcagttttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagactagtttccgaggctgagcatggtgggtcacacctgtaatccgagcactttgggaggccaaggtgggtggatcacctgagagcgggagctcgagaccagcctgaccaacgtggagaaaccccatctctactaaaaatacaaaagtagccaggcgtggtggcactttcctgtaatcccagctacttgggaggctgaggaaggagaatcacttgaatccgggaggtggaggttgcagtgagctgagatcacaccattgcactccagcctgggcaacaagagaaaaaaaaaaaaaaagaaaaaaaaaaactagtttctttaaaatgtggatatcagttaaaatctgtgtattgtattgcattttgaatgcactggattaattccatttttaaatgaaacgtggaaaatcttgttttaagatgaagaatccttgctaaatagaatctctgaaccctaaaatggcttttttaattgggaattttcaaaatatgaatttggttagttacaacaaacaatcaaaatccttacctatgaattgccctcttctaaagcaagaatgttcaactcggatatctagtggtaaagcaaaaagagatttccctgttagtcctcttacaggttgtgggcattgcttatttgactttgaaacattaaagaagaatgtgtttcagggcagacatgttggtaaaactgtttctgttacaaaaattttagaggacaacccaacgttttaatgtggtgaacctcatttatcatcctgtcactgcaccatcttttttcagtttcatcctggaccagggtttcatggcacagaaaaaaacctggccatcaaatcatagcatatgaacaagtagatggccaaatgtttgaaagcataaacatgcctctctcattgggcactggttgagagggttcgaagcccattatttgtaattgcagttcagactaggagaaaaaaaactccatccagaagagaaacgattggaatgtttgtatggatttgggttttgatagcttctgtaacattccatcactgtttgtgtgagcattttccaatcagctgtcccaacatcaaagccatttctgcataatttttttttctctatattgcttgttcttttcaaaatttggttttctatccccttctcccccagtctcagtgagatttgcattttaatgtatgatctgtctaatgtattgtctatttcacttctaacagttacatctcttacatttacaaatgtacttcaccatatttcttccagacagtcacctttcttattattttactgccctcatgacataatattgtaactatctgcagctcttggacaaagagaacctttccagaagagctttcaactttttctcttttgccttggagtatgtctctctacctctattatgttcttgtaagtgataaatatcttatgagttttttttgtctatccataatgataatagaatctgagcattaatatttattttggtggaccatgcacaatttctaaaatccataatttattttcataaccaatattacagtaaattcattaagcatatacacggtttggaggcttattggcttaataggttcaattcatagaaaaggataattcactacctactcaaaagcatcctaccttgagagtcagctaagtggggaaaggaaaaatatgcttttctcttcagacagcctttgtatcagtgtttcagtaacatacatgactacttattgccatttcatttcttctctttgaatattgcctttgcctctcctgggacagtagagttaatcttataggaatacctaattccacgaattccttagaatagtataaggctgtgcagtgattggcccttaccttgctctctggtctctccttccaccaccggcttctgagaggttcgcagtcttacatcttgaaaaccactttcagtttgtgaaatggaccaggattcttctttttcttttctttttctctcttttatttttttttttgagacaaggtctcacactctcacacagactggagtgcagtggcatgatcattgctcactgcagcctctacctcactggctcaagcgatcctctcacctcagcctcctgagtagctgggaccacaggcatacgctaccatgccagactagtctttttttgtttgtctgtttttgtttgttgttgttgttgttgttgtttagagacaaggtctcacgctgttgcccagactggtcttggggtcctgggctcgagtgatcaactgcctcagcctcccaaagtgctaggactgcaggtgtgagccacttcactcagccagaccaggattctttcaagttttggtgacattacttatatttttccctatttttggaatattctccccatctgattgcactggaacagctttctaacatttttttcaaggctttgttaaaccataaaattaaaaaaataaaaaaacattccttgagattaattctcctggctgtgttgtgcaatccttctaggtgcctgcatgctctgtgcttatctttaatgataataaccctttatgtgttttaaatcatttactcattctgacaagcatattcagtaaacaactgtagttatcatcagtcctattttatgaatgtagaaaataatgcaaagaaaattaagttacttacccaatgtctcacagctaatggtagaacaaattttgaagaggtctgtgacaggactgtccattagaagtcgaatatgaactaaaaatgctatgcaatttttaaaaaatttcaagtagatatattacaaaagcagaaagaaacaggtgaaattcattgtactgttattttattctcaatatcatttcaacatatgacctataaaaatgagattttttttatttcttcacactgagttttcatatccagtgtacattttaaacttaaagcagatcttgattcagactagcattctagaacacatgtgcctaattgctacctttgttcaacagcacaagtctttactcttaattacagcacccctctttgtattgaaatagttttatttgcctacctgccccattctactgtgtgcatctttactaggtgaagaatgtgctattcatttctttatttcaagtatatagactagttagtgcctaagatatagaaacaataaatgcttatggaattttgttgctgcagtattgcagtggcttcagagtacagagatttttggatactctttttagcaatcattgtagaattgaaaatctaaaagattcaaaacgcttgacaaaatttctagaaggcatgtatttgcctgttagacttctgagcaggtcatacaagaagattgggaagctatcctggaagttagctgtagcccctacagacagtagaatatgccaagtttccactttaagagtgcatgtaaatgctatgacttttactaaaaccacatggcaatataataaatgaaaatgtggtctaaacgtgttctggaacatttcctaattattataacatattgtattttgttatcattatttagtagaaaaatgggatcagaattagcattgtaatattattttggtaaaattatgaatgggatcatgcctcatacatagtagatgcctaataattattaatctgatttgatttatttgagccagggttagtaagttcaacttctactggtttctgttatttatttgagaacctattcaacttgccatcattgggacaagctgggacagttccttaaaatgaactctattagagtcaaattgttccatctgttttccctaaatgaaagaagattcccttgatgctagtcaatgagtgagggctccttgactcagaaccagatgcaagctttataccagccttccatttcagcccaattacattcttggcagcctgtgagactcatggggtaaactttttataacaattatcaatatcagccaatttttcagaatgggcaggaataaacttcaatggctccaggatgagttttctgtcttccaaagcctctgtctggctggctgccatggagaatatgtaggagcataaaggctgctgttttatgtaacactctagaaatcagctaactttatgactacttagagttttaggattttatcaatctaaattaattatttaatattggcttaggctacttttttgtgacatagagaacattatttttattcctgtgatacagacctccaaggtgtgtgtgtacattacatagcaatgactggagtctggtttattgttgactccctcataaagctattgtggacgaaagagagaaagcatcttactgatgggatatagaatcagtgaaaacctggaaccattgaattcccattgggttagtgtgtgtatattaggatgggaggtttggggaagtagagtggaaattgatggtgttatgagatgacgtcgtgacctttaactcaggaatgactcaatcctgtcaatatctaacaatccctatacattgtgatctcaggtagattgttttgcaatggcaatggcaattatgaacacacactattattcactgaatgttcataatcacaaagggaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaatctgcaccctgaccatgtgatagaaaaaaaaaaaaaaagcccatttaacagggaggaattcaagcaggtggcagaaatttgcataagtaaagaggagccaattactaatagccaagacaatggggaaagagcctccaaggcatttcagagacatttgtggcatccactcccataataggctcagaggcctaggaggactgaatggtttcatgggccaagcccagggccccactgccctgttcagccttgggacactactccccatatctcactctgctccagctccagccagaaaatttgcagcctagtcatttggtagaaaagaaaagccatttgcaggggaggaattcaaacaggctgcagaaatctgcataagtaatgaggaaccagttgccaatagccaagacaatgggaaggccttgaaggcatttcagagacctccatggcagtacttctcctcacaggcccagagacttaggaggtctgaatggttttgagggccaagtccagggccccacggacctgtgcagccttgggacactactccctgcatcccagtcacttcaccactagccatggctcaacaaggcccaggtacaactcaggccaccacttcagaggatgcaaactgtaagtattggtggcttccaagtggtgttaagcccatgggtgcacagaatgccaaagctgagccttgagagctcctgcctagatttcagagaatgtatggaaaagcctggatgtcctggcagaagcctgctgcaggggcagagccctcatggagaacctccaggaagccaatgtggagggaacatgtggggttggagtccccacacagaatccccagtggaggactgtctagtggagctgtgagaagagggccaccatcctttaaaccccagaatggtagatccaccagtagctttcacatttagcctggaagagccacaggcactcaacgccagcccatgagaacagttgtgggggctaaaccctagaaagccacaggagtggagctgcccaaggctttgggagccctccttttgcgtcagtgtgacctggattgagacatggaatcaaagaagattattttggagctttaagatttaatgactgcttttctgggtttcagacttgcacagagcctatagcctctttcttttgaccaatttttccattttggaaagggaatatttacccaatgcctataccaacattgtatcttggaagtaactaacttgtttttgattttacaagctcatatgcaaaaggaacttgctttgtctcagataagactttgagttaatactggagtgagttaagactcggggggactcttgagaagatatgattgtattttgaaatgtaagagagccatgagatttggaaggtgccaggggttgaataatatggcttggatttgtgtccatacccaaatctcatgtggaattgtaatctccaatgctggacctaaagcctgatttgaggtgattggatcaacagggcagattttcctttcgatgttgttttgtgataatgagtgagttctcatgagatctgatgttttaaaagcgtgtggtacctctccactttccctcattctgcagccgtgtaagacatgcctgctccccctttgccttccaccataattgtaagcttcctgaggcctctccaaaagtagaagccactatacttcctgtacagcctatagaactatgagacaattaaacctcttttctttacaaatcatccagtctcaggtatttatttgtagcagtacaagaacaagcaaatacagagagccaatgcatcacatggccagagtagaagcaaaaaagttaggggtaagatgccacacatatttaaatagccagatattgtaagatctcactatcatgaggacagcaccaaggatatggcactaagcaattaatgagaaacctgccaccataatccaatcatctcctaccaggctccacttccaacattggggaatgacattcagtatgaaatttagagagtacaacatccaaactgtgttaatactgttacagaaatactcaacaaaatactaacaaactgaatttagcaacatgtttaagagattatacaccatgacccactgggattattcctgtgctaggatggttcaacatataaaaatcaatcatgtaatacactacattaacagaatgaaagataaaaattacatgatcatcacaattgatacagaaaaaatcatttaataaaaaattaataccctttcgtgatgaaaactctcaacaaactaggaataaaagaaaactatttcaatatattctaatccacacatgagaaacccatagcacacattactcgcaatggtgaaattgctgaaaaattgtccttgaagatcagaaaaatgataggatgctcacttttgccacttctattcaacatagtactggaatttctgatcaaggaaattagccaagaaaaagaaataaaagccttggaaactggaaacaaagaggtaaaattacttctgtttacacatgatgtggtcttagaaaattttaaagatttccaaaaagtttgttagaactaattaaaaacaataagcaaagtgacagggtacaaagtcaatacacaaaaatcagttgcattttgatacactaacaaacaacccaaaagaggaaattaagaaaacagttctatttgtagtagcaccaaaaggattaaaatatttaagaatttagttatctaaagagataaaagtcttgcatacaaaaagctacaaagcattcctggaaaaaaaagatatatattaatgaaaagctattccacatacatggattgagagacagtattgttaagatgccaataatgtccaaaacaatatacacagattaatgtagtccttataaaaatcccaatgattttttgcataaatagacaaacccttcctaaaacttatatggaatcttaaggtatccaactaatcagtacaatcctcaatatagaataacaaagcattgagctcatacttcatgatttcaaaatttactgcaaagccacagtaatcaaaacagtgtggtaatggtgtgttagccctttttttgtgtgttgctattatacatataaagacatacctgaggctgggtaatttataaggaaaatgggatgtataggaagcatggtgctggcatctacttggcttctggtgaggcctcaggaagctgtcgatcatggcagaaggaaaaagggtagctggcatctcacattgtgagcaggagcacaagagtaggggcaggtgccacactcttttaaacaaccagatctcatgtgaactcggagtgagaactcactcattaccaaaaggatggcactaagccattcatgagggatccagccccgcaatctagtcagcttccaccaggccccacctccaacactggggattgcatttcaatgagattgggaggggagaaacagccaaaccacatctattggcataacaacagacatatagaccaatggaatagaatagagggcccagaaataaattctcaaatatgtggttaacttattttcaacaagggtattgagacctcagtgaggaaaagacagtactttcaacaaatgtcattgggaaaattgtttatctacatgcaacagaatggaatgggattgttaactaaaatgatgtttaaaaactagttctaagtgaatctatcacttaagtgttaaacctaaaactataaaacatttagaagaaagcaggacaaaagcctcaagatttgggtttggcagtaatatttcttggaaatgacatcaaatgcacagacagcgcaagaaaatatacacaaattggacttataaatttttttaagtgtgcatcaaaagacatcatccacagagccataaggtaatccatagattgggaagaaatatttgcaagtcatatctatggtaagggattaatatccagaacatatagaaaatgcctacaactcaacaagaattacaaaacaaacagcataattgatagacaaaggagttacatgaatatttttccaaaaagatatgcaaatatccaataatcatgaaaaaagatgctcaatgtcactaatcattaggaaaatgcaagttaaaaccacaatttgataccacatcacattcactatgatgcatactatcagaaagaaagtaaatagaaaatatttggtgatgacgtggagaaactgaaagtcttgtgcactatttggtgggaatgtaaaatattatagctgctgtgggaaacagtatgatgtttcctcacaaaattaaatgcagaattactgtatgatctataaattattcttctggataaatacccaaatgaattgaatgcacggtcttaaagagatttttatgtacccctattcatagcagcattattcacaaaagctaaaatgtggaagcaacctaagtgtccattgatggatgagttggataaacaaaatgtgggatatacatacaatgggatgttattcatccttagaaaggaaggaaattctgacatatgctacaacatggatgaaccctctaaggttcatccatgctaagggaaataagctagtggcaagtagacaaatactgtatgactttatttatatgaggtacttagagcagtcaaaatcatagacacagaaagtaaaataatggtttccaagaagtgcagtaaggaatgaagagttactgtttaatgcgtacagattttcagttttgcaagatgaaaggggttctgaagataggtggtggcaatggttatccaacaatatgaatgtacttaatactgctcagttgaaaacttaaaatggttagtatggtatatgataaattttatattgtgtgcaatttactataattaaaaaatgaggaagaaacacagtttaattttaaataaaaacacacatgtatatatatatataaatttttgatgtgataaaatatggtctcccataagaccaggaggacttaatcaaatttgctccagctttatgaccttctttagcccctctgaaagtcatcactccatatttgctgaggttcgaagttgggtgtgcaccagtctggtagagactagctccacttttagccatatgctgttgtgctgctaccatggtttctcacatttgttaactgacactgacaaggctgaaagaagcagtggcatgcaccttgcaggggagacatgaatgcgtccacacctgaatttgccatgttcagacctcagttatttcccctaatagaacaaattctgatagtacgaggaatgttgagagctaccccttcaactatagcctctgggtgctgcaggccataaccaggtcgggtgtgtgctataagggggtggagatcaagcagcaccatcccctggggcagctattaaaattttcacttccaaattgtatttaaagtctgtctcccattggaattctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacccagggtacttttagtaagatgagatatgtgagccataaactgtgtctaagaagataaagtatgaaaatatatgttcaaaaggagctaaacaactgcatgcttcacatttgcctccagtaattcaagaagagatgaagtgcaattactcatatgcccctttcaacatactactgtgggtcaactgggtccatcatagaacagtattagggaagatcttctatgtcatgaataaagagttgctcaactgtggcttaattatcatttaatagtgactctcttagcttcataaagtacattcttcaaagcttgaagctaagtagaaaggcaaaagaacacacaggttggagggtaagcttaaggaagcagtataagcatcgttcattcattcagagataaccggtattgcagtaagtaggctggacttggaatcgtaattcaggagttttagttgctgattcttcactgggttcaatgaggcttttttgatgactttttcatcatggatgaaatgaagtcgttggacaagatgacctccttggttccgtccagctctacaaaacattttggagccaattattttgtcgacttttttctcaggggtcctttatagaaacagtgtataaaatttactgataaagtaattaactctttttgacagttttccttcagttagattaatattttcagggttcatctatcttgtactatgtatcattatttcattctcttttattgataaaaatacttcattatatgaacatatcacctgcatatgattaatgtatttaatattgtcaacttattcagaatataaatactatttgtagagccctatattagtagaggtaaggatgagaatattcaaattaaatgagaaggattacacatagcaactataacacaagaacaaaccatttttgtttcaaagttggtaaaaagttaaactttacttggagtagatgaaacaaataccaggcaaatggcacattgttttgtttcatattacaccagtagtttcggttttacagccaaaatatatctaaagttttgtatttgaaacttttgtcatctcagttgtttccgttttggtcatcactattttttcatatacctttaaaaaataaatttattgatataaaatcatatagcataaaattcacccttttattttttaaaaataatttttattgtgtctatttaatgtatgtatacatcataatgttataagattatatatatatatatctgcatacatagtaaaatagttagtataggggaacaaattagcatattcatcatctcacatagttacccattttttcctccttgtgataaaaacagctatgaaatttgcctttttaaagtgtacaattcattgtttttagtatattcatagaattgtctaaccatcattgctgttcatttctgaaatgagttcatcatctccaaagggaaatctagtacacagtcatttctgattttcctccccccagtctctagcaatcactaatctactttctatttctatggattttcctatttgaacatttcctatagattgaattatgccatatgcagctctttatgactgtcttctttcagttacattcatatttttaaggtttattcctcgtgtaccatgtatcattccttcattcatccttattgacatataaataccaatattattatatggatatatcacattttatcaattaatcagttcatgatactgggatggcttcctttcatcatagccttactaccttaacatcttcttattttttcttttcattatgtgtgggtgattaacctctgggattttactctattcttgctttgttgtctcatccagtttatatatgaattccaaaatgctcaaaatgggaatacttagacactaattcaatgagatacataaataccaaatatatactcagtcttattcaaagtaattgggtaaataaggaaattttaatattttcttctaaaaagagtacacagccattttgatggttaatggtagtatctgataacaggatgaaatgtaggtagggtggagaattaaaaaatgcttactaaatcatggtagttacgttacctccatcatcatcatactcaagatcactttattggatacatactctgtggaaggtacttcatttttaatatgtattatagtatttgatattaaaacaacttattttggacatgtaggatttttaaaaaattatttcagatgacaaaagtaaattacagatagctaatgtaaccagctccaaaattaaatactgttatgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctgtgtgtgtaaaactaatattgtttgggaggaattcataattcatagaagaggtggactttcaaattgcccatgatgttagatgaggaaaatttggttaatcgtgatgagaagtgaggcagggtcactagtttgaagaaaacaaccacagcaataaaaaatgtactctccacattcatgttctaacactgattgatgttaagttgtaggtttagagttcagccttactggcagacttacttgtaaattccgactgctccttggccaatctgattattcttaacaactcaacaggagacttgaaactttaatggagatttgtgattctcccagggcgtatatctatatcttctcagcagtgtcagactgatctgctgccaacatgtttttccccctctcagtaaaataaatctctgactacacatcctggcaaaagcacacatttctcctggcaagcttcctcaatgggcatcgaatatcttgagatttcagacaaaatcatttttctccaggggaaacatgactcgtgtagatgacaggaccccagacaaacagcaaactctgctcagaattttaacaattactaaaaacatatttcctatcacagactcatttttttttgccaccagtacaccccccccccacacacaaacacacaggtgcacacatacatgtgcacatagtcaattttcctgtacttacctgcattatgaaatgccaaacttatggtgagtttggagaggcaattttttttttttacaaataataccctccataaataaacatagttattatgaatgcacactcattgtgtaatagatctgtggtttgtgtcacttagccaactttgatcattttctgtcatccagaaaataacttctttcttaacaaccaacacataatcaatgcttggcagtaatgggcatgtgatttaggtttgtgcctaattagcacattgcataccactaatgtacagcacaggaatgagtacctggaccatctatgaccaatgaaagcaagggacctcctactgagaaccctggaaaatatagttttggtttttttatgttgtcttgaaagtgacaggctgtagggattccatatgctatagtcattttttgatcatgaagagaaagcttgtctgaatggagccatctgaaagaaaactatggtaagatattagtcatgcccctgatgacaacactgaagtatctgtatcaagtcatgcatgtctgcatgaagccctacatgcagtcagccagttcgggaggtaatctcattcaggcaggagtttctgatacttcaaaaagcaataaatagtcctttagttttctcccacctcctacctaaaatagaaaatggtaacaatgacttatctatcaattcttagctgatcatccttcttctaaaaacattaacttgtatatcgtgtcacgtgcctgtagtcccagctacttgggaggctgaggcaggagaatcgcttgaacccgggaggcagaggttgcagtgagctgagattgtgccactatactccagctgggcaacagagcaagactccatctcaaaaacaaacaaacgaacaaatattaacttgtataatagctgtttacagttaggtaagttacatcctgggcataagaacaaatatgattaagtccattatacaattttaggctcatcagcattttttcttaatcatctgaatttttctcataaactttaacactgttccaaaaaaaaaaaaaaaaaacaaacaaaaaccttaaagcctacatatgcttgagaagttattttatccaaagaaaaacgacaacctattgcccaaagttattgcctcatttccacttgctattaccttagaactaactagtgttttgatattagtaaccatcctataactatttctttgtaagtattttcatatattttatattcgtgcccttcattcttgggtctgattgttgttaagtatgtgaattttaattattctttctgtcacttcttttaatgttgtttctgtttaaatgaatgcaatactaccaatttattcaactaaatcaattttctatttaattaagtcttactttatggtttaattatatacttggattacagtgatcaatcttctctctagagatttaactgaaatatgcagaaattgataaaggtaaagttatgtcattatgcatttgaagagtcatagcatctgttgtttagatgtatgaattagttttccagacaacaaaattcttcaatactactctatgcaattatgttgagaactataacatctattaatatgttccttttgtctacattttaaatacagccactttttctttgtatatttcagttatgatattgcaatttatttttctttctataatgtcaactgagagtgttaagcttttgaaatagccaatggtgaatttttagtgtttagtgacatagtataatgcctaatctataattttaaggaataaagtctgatctaaaccttgatatgttcatgattgccactgtgtattttataagggaacatattaaaattatcagttagtttcccttgacatgtttgcattacacaaattttccacagtggatttatattattttaaaatcggaaaatataaaaaattattgtctttgacccatatgtctttttcttctatcaccttttgtatgtcaatatgctgatattaaccatgactacagaaatattttcataagggtgagaaaacttgcttaagttttactggcactagtaacatatccatctgtccattcaactgaaatgctaatgagaagacattgcatcttgaaaagaaagacatagctttatcaaagatgttggagattaaacatgtttgtcaattggacaatgtcaacaatgcagtttagatgttactttaaaataagctctattttctgcatgtatcactgcagtgtagagttctagacctttgggatcatataaacacatcaatctttatatttactttatatgagatgctcaagtggaagagaagcatgaatctgcttacatctttcctttgcctggtgatttaaatagactggaccattcaacaagagtgttgagtgtatgagtatgaagtctagaaacttttggtaagagttttaactgaagaaagttaatcagttaaagctggtggttatgctactattctgcaaacaacccttctggtgggaaaatatatttaaaattctagagagagattttattttcctcttatgctatctttttgcaaataatccaaagaatgaaatggtcgtgtgaaaattgctgctattcacattttagctacaaatcagaaaaacatcatttagttgagtggctatcaactgctccattatctagcctgaaaaaggctctttatcacaggaagtaccattcataggatcggcacttccacaagaattaataatgattacttacaattatgatgacttttaaataaaaacgaactttattctggttactttttaggtaaatgcttttattttggatatctaactttatcttatttaccagggatttgattcattttttaaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtagccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacattaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaacaagacatttatacagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgcggagaaataggaacacttttacactgttggtgggactgtcaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactcctgggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaatatgtatctctcatgccatgttgtaaaacaaacaaacaaagaaacaaaaaacataccttttagagtgtatggctattttggaaatccaaaagaacagtcttttagttacattgcaatgatcggtgattaacgtttaaaatatagtaagtaaaagatatcttatttgaatgaggcaaacaattaataggctaacacagattccagcaaactttttatttaaagaaccagagggtaaatatttaaggctttgcgggccatattttctctgttgcaactactcaactatgctgttatagtgcataagcagccatgagcaataaatagatgtagctgtgttctttacaaaaacagttcttagaaagccagattagcccaatgctgtagtttatggacccctgatctagtatactgtaaaccaaaaataaaaccctaaggcccccaacagaccaaacagactctctcttggccaagaggaccccagaaaaacctgaaaacctgaattcctggctgtgatgggaagggatgttgaaccctcttctttatatctccttccttttggaatttaagcacaactgaccagcattcaggttaaaatagagatcacaagaataacaaaacagtccctttgtggctaattaaaaacaaataaaaggccatgcaaggcaaaggttaagtcccatcctacaaaccaaaaaattttgtaaaactggcgcttttttttttttttaaattaagctggtacaatttgacttaatttctaacctaactacagatagcagaccctgaaggaaacaaacatattttaccccaaaatatattttttgttatattttgaaatggccccacaaaaccatcttttgtagggaaaatttggatctgcagacaatctctattaatgtaaccagaccttccctttcccaagcctttcccagatctaggggagattagctgacagtctgacaactttaatgtctgaaaagagacatttaccatctattctctctgaggcttcatctgcataaaaagagccttggcctttacaaccccctttaatcttgattcaagcatttatttcttctgacttcaaatatttagacaaagtttaactcttgcaaccaattaccaatcagaaaatctttgaccccactgatgacatgtaaaccttccccacttcaagatatcccacatctttaggctgaacccaggtacaccttccttgtatttatttatagttgtattagcctgttctcatggtggtataaagaaatacctgagactgggtaatttataaaggggagaggtttaattgactcacagttctgcatggctaaggaggcctcaggaaacttacaatcatggcagaaggtacgtcttcacagggcagcaggagagagaatgagtgccagcaggggaaatgccagatgtttgtaaaaccatcagaccttgtgagaactcactcgctatcaggacaacagcatgggggaaaccacccccatgattcagttacctcctaccgggtcccctgacacatggggattataaggattacaattcaagatgagatttgggtggggacacagctaaaccatatcaatggttttacctacaattccgatctccctaaaatgtgtaaaaccaaatggtaacccaactcccttcagcatatttctcagtacttcttaagaatgttccctgggccatggtcactaatattggctcagaataaacctctttaaagtattttacaaagtttatttcttccattaacaatgctaagtttaaatttatatatgtgtaaatgtattaaaaattatttaaatgtaatattgtaacattatgaaagtaggttatgagagttgagatttgcaagatagtattaaaaaatattctgacactaaaacactaaggaagaccttattcaaagcaattgcgagagggctgtgcgtggtggctcacgcccatattcccagcagtttgggaggccaagattgtggatcatttgaggtcgggagtttgagaccagcctggccaacatggtgaaaccccatctctactagaaatacaaaaactagctgggtgtgttgactcacacctgtagtctcagctattccagaggctgaggcagcaggatcacttgaacctgggaggtggaggttgcagtgagtcgagatcccaccactgtactccagcctccagcctgggcaacagagtgaaactttgtttgaaaaacaaaaacaaacaaaacctcccccaaaaaacccataccaaaccaaacgaaagaactattgcaatatagagaagagacttaactccaactacagcaaacactgctagaggtacttagagccaatgagcagaataatgcagtcaatgcatggaaaactactaacaggaggtatccagggcagggggagtcttgctaaactggtataagagttatagaggaaagaaacacgaaacacggctggcagttaaagacaggttttctttagttgaaacctgagaggtgctcctggctagtttgtcaggagccctttctcttacagactgtgagtatatatttgttttagggtgagaaggcttaccagaagcttggaatgtttatgtgtgtggataattttatggtgggctggaatgtctctgggaggagaggagattatcttggggcagacatctcttcagccaggaggagggttgtctcggggctagcatcttcctggctggaaggggttatctaggggctagcatgtctgtggtcggggaggagtttggaatgtttctggttggagatgttatttgtggtttatggtcatgctgaccttagccattaggctgatacactttggatttaggtggcttttattaggttgaactttagaatgaggggcatgtccaagatggcaatgctcctgctctgtcaactggattaacacaatttttgctaaaggcaagccatagacttaaatttcaagggtaggggtagaggaatttgatcaagtgtcaaaggcaggaggattctcactaaactgacccagcaggattcttgttaaaggcaggccaaggtcaagggctagttgtgaagtagatggaggagcctgaacaaattttagtcaaggcagatatcttcatcaggagtgctaaatgcatttctaaataacgtcacaacagcaatcaataaataaataagtacatatatatatatgatcgatgtggtcaaaaacttagaggaaacaaaaatatttgctgtgatcattctactggatggggctgtagtacatactctaaaagctgtgaatgactgaatggtggctcaccaaaaattccaccaaaataacctattaaagataaagcatggctgacttaattgcttagtttggtaaaaaagatcactcttgtcacagaaagtgagcagcatatggaaagagaaaagcaaagaagagttgcttataaagttttgggggtatgtagtttgacaggtatttcaataagtggtcttgattagagttgggcatactttgtgattaagagtttaggataggtgaattgagggatgtgagtgctttggagaagctcttaaataggaaacagtcatttgtttgtgctgtatgttgttctgagaaagatatatttatgagccttagatgggcggtctatttttcaagtaaatgggtttttggaaagttcttgaaaaaaaagaaggttatttgcaacttcagcttcctggaaagaatttcctgaaatattaaagtcatatcaatgcagacagttgaatagcaaattgtgttaatgtaaacagtaagatgtgttggtatagatcgtttcaattctcaaaggaacaagaaataggttccttcttgagtttataaagtaattgaaaacccaaaacaaacacatcaaaatggaataaaaaaactcaataaaaaagatcgaaaggaattacatgattaaatattaactggcacaggagttcagaagagagggatattaggtgaatactttaaaggtgttgggaatttaacaatgctttgaaaaaagtgaaaagtttggacaagatctggtgtatttattagtgggcattgtaagaaaatctgagtgggagtgaagttttacatatgtggagaactgtaagccacagataatctggactattttataggctatcggtagataataaatatataaatatatgttaaattttatattttattattaggaagccacaggtctttgaggagtgtttgagataatggtaagtattgtgttgaattgattgggctgtgtaatggtaatacctagagccatagaaaactcttacaaaactagcagtagtctgggtgagtggtcataaagaacaatataaatataggagatgaagatacaggaaaggtgtaaccaacaggatggtatgtatgtaaatggaattttgagggagagtagagccaaaactataaaaagtttaattgtagtactgagttttatatgtctacaagatatgtgatctagcatagaattagaaatatagaactggcctatgggaaatgtcaggacattagttgaatgtttaagaatccatataagaaggtgtgagtagtaaaatagtcactgaagagctgttggaaaaaaaaaaaagcctacagctgagtttggaaggatgcctttgtttagatagcaattgagaggaaagagcatatagaaaaatttgaagaacaaataccagggcaagatagtggttcaaagtcaagagaagaggattgcaaaaccctactgttcatcatcattgttacacactatgaagttgagttaggtggatattaaacatgggggaagaacatattgtatttggttattgcaggtcagtgatgatgctggaagtctgaaatttcagtagagcaaggactgcagctgtactgcagaagatacagagaatagcttgtatggctgttatggagaacaaggtggaaacccctcaggcaaaaggtttattgaggcttactgtgaaagggaaaaaactaggaacagagaaaaacaccagacttaatgtactttttatttatttatttattttttgagacagagtctcactctgttgccaggctggggtacagtggtgcaacattggctcaatgcaacctccgcctcccaggttcaagcgattctcctgcctcagcctcctgagtagctgggactacaggtgtgcaccaccacggctaatttttttatgtttagtagagacggggtttcaccatgttggtcaggctggtctcattctgttgaccttgtggtccacccacctcgacctcccaaaatgctggattacaagcatgagccaccgtgcatgtactttttttctttaatccttttgttttttgaagcagaaataaaagatatttaagagcttagagcgcattgacttgtttataaaacagagcttctctttgcgaaggagaaagttcatctcttcccaaaagtcttgggaaaaaaatgtgcatgcaatgagatcttgaagtagaaataaaggatattgaagccatttctaatggcctcagtttcttcagttaaatatatggatcctggggctcttcaaaatatgaggaaagtttaacattgttgtgagcagtgttttagggagttgaattaggagcctactgtgttttaattgtgagtagctaaatattctagatttaccattgatatatttaattaaagaataaaatcttgttgtttaacaaacccttcctagatttatttgagcatttcctgtgatagtcatttcattttttccacattttatttttaattgctcagctttttttattgagtatagtttcttttaaaacatggaatgctacagaatttcaattgtggatatatcaaaaatagttttaaatgaagattatgtttggattaaagtttctcagagaactgatttgccagagttttttctactttttgaaaactctttctctatgtagagatagattatatatttattgatttaattttaaaacactgaaactagattatcacgtcaaaattaaatgcatacttaaattagccgttagcaagaccaacagaaaccaatatggtgactttttattgttacatatggaagatgaattttgtcggatttcaacttctcagaagactcacagcataacccgttaagcaaagctgagtttattacctataatagtcagaaaagacaacattttacaagagtcggagtgtccagaaggagaggattaaggcgaaatatgaatagggttggaaatctaggtttgagtagataagactgaactttcaatgtgaggatctggtttggttaggcacatttcaagacgtaatagtttaggattggtgaacacagaaaggcaggaatcttgaagtgagttgtttgataattgagccatttacccagttttaggagtttaatgtttctagaaactaattttcagccattttctgaaaaaaaaaaaaaaaaaaaagtttttcgttctgatttacaacgttaagttcataaacaagaacttcctagaacaaacagtaaaataatgtgaatgtaggctgcctttatttttggtcctgatagataaggtggatgcagaagtctcagttcttaatttcaataccacattgagaactaaattaacaatggaaaatgctttattatctgctttgtgtggaagaggtataaaatataaggctgcatttacctgaaagattttaaattaggatactatgtttttctttttgtcagccaaattatgggaaaaaaaattggatcgaaatggcagtaatgatagttagggttactgcagactgaaaatacgtgcttagatctcagggtacacaggccagatagtgattctattctgccatacattttcattttaggaaaactgactgagtcgaatgtgtgttcagaataattggctcttaactgtcaaagagttaaaaaggagaaaagattatttaatcaaagtaccttgtagatatgcatagtgccatgctttaagaatatttcaagtactcctaccttaatctttccatgttaatgcacttaagtcattgatctgattcactcatatttgattacttaaagttaaacaaaatatatcatacaacatttagaaatgtagttccagaatgaaggatcactattagtctggtagataactgttaatctagtaacaggagtttcaaaactggggattccactagtgattataaatcaaactgtaaagtaggataaatatgaaatccagaagaccagattataaagaacaaaaaaaaccccaagaaaattaataagggcagatattagtttcttttaaaataattcatgcaaaaatctttattatttattaagctagagaattacatgtgaattttaaaagtttatcctattaatgcaacattgagagtctaacagtaaaatttgcaggagtgtagatctaaaggtatttacaaatctcaattctctgtagatttttctcaaggccaaataattatccaagaaaattgactttaaataaactgatattaagtgtagtctttatcttttcaaacaagcttcacttccttctactttgttctaagggaaatcatgatgaattttctttcgatcacccctaataacaacctatcactcatttaagattttctttcactatgaggaactatggggtcacgcatttctttttctcttctcttgactaggaatcaccattcatactaaaattgctctatggcttttctttctctctaacaccacagacctcatctcaatttaaaattctgcattgtgcttgtgtactcacccaatgatttcttcctatccactgcaaaaaccagttcactgagacgttggtattgcagtaaagaagagtttcagtaacatgagattagccatgtgggagaactggagttattactcaatgagtttccctgaagtcttggaggtcagggtttttcaaggaaagtttggtgggcatgggactagggaatggatgctgctgattggttgggggggatgcaattataaaagtgtggaaaactgtgcactgagtctgcctctggatgggaggtcacaggactggttgagtcatgagtccaggtgaggccagtctgaaaatcatctcagaagaccaacctgaggttctacaacagtactatcatctatattatctatatataggcgagtcacaaatcttgtgacctctggccacatgacttttgagcagtaagggattatagaaactatagctacattttaggagaattcaggcctctttcataatttcagttttgtgtcctttcattagtattacaagggtggtttcaacccctgaacgaggaggggatgaggtttagggagggactattattattcttgtttcaaggttaaactataaactaaatttcaccaatggttcgcttggccaatacccaagaatgagtgaagacagccagcctacgagcctaaaagcaagatggagtcagccatgttagatttctttcattatcataatctttgcaaagatgtttttgcctgccttttgagagaaaagctacttgtcgagtgttttgttttgttttgctctatttatctccatgatgcaatggaaaatggaaatttattttctcttaatttattgagaaaatattgtaaggatgattttgttagggcatgctatttggctcttgataattcatgatgatatgttcatcacaatcaagaagtgggccagagatgagaatattttaaaaaattcatagagggaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaaaaaaaagaacccaattcctttttagctgataaaagaagttcagaaggtgatacaggccttaatttaaagatcatatagaactatcagtccatacggccagcctcagggagtaactgggaaatcccttctttatctccttactttcctccttcctaaaaagtccatttgactttccctgtttcccaggccacagttccaacatgtcactgttcccatgtgattaaggtcaagaactactggccctctgtgttattcttgactctaacaggagagtcatattggactatgtgttttgaattagatactgaagaaaacaaacttcagctttgctaatatttcttgcttcttgtcatataaattgtacgtgtaactattaataatatttaaataatgagagaaggggtcagaaaatcttgttctgccaaaagtgtcagacaccttttcgtgtgtttttgtggctaatctttgtaactcatcatttagtacttgttttataactttgcaagtggagacattcagtttctgagagattgtaacttatacacattcattcactataagtagtgaatctaatctccattaatatcacctttcttcctagaatgagcaggagattagggatgtgtaagcaagaaaaggctagaattgggtaaaattgggtaaaaagattatgatttaaaaagagaacatattcaaacctactttaatgtggctatcttctcttttacctaatcatatatatatatataattatgtataattatatatatatatatatttatctccagagtatccttatatcctgtcagttttacctcgttagtaatttcaggcagagatattgttaagatgttttaattttctaacaaatatggccaaacttacctcaaaaatatgtaaaagcaattatctgaaagaaatgcaattatttaaaatgaagacatagttcttctagagttgaaaaagttcattcattgatatagtagtagcctcagattttgagctgcaattgtgcaagccaggtaaaataccacagaaaaaattcacaacccagaagagaattcaagatgctgaataggaattcagtggtggtagaagaattggatccataaataggtctgcatgagaatgattcaatcttaggagacatagaactgttagagttacagtcaactggcagcacttttaagttaaaatactggatcatcatcagtaatggtttactttagagactggaggcacttctctttgcccattttttctcaccacagaatgtgcagcagactgcccatattttaattaattttcatttgttaaaccatgaacctgagtggccctcatactaaccccttgttcattgcacaatagaccatgtgttaggcgggcttcctgatctttcacgagaatgaatgccaagtacagaaatctgcttgggttattgaaggctaaaaatgattattctaatgtgtctgtttattttgcacgttttctcccctacagttactatattatctagtcaatgtatttgtcaattgtgaatgtctttgttgttgcagatacagatgtggtgtataaaagcgagaatggacatgtcattaaactgaatatagaaacaaatgctaccacattattattggaaaacacaacttttgtaagtaatgaataattaattactttatgcatttcagtactgtttagaaagctctctagatgtacataactttctattcttcagctccagcatttgtaaagcatttcaggtgaaaagttggggctggaatatcataagaatcagtaaatctattgataaaaaataccctgtgactatctgcttcattttcttcccgtttactcttgttaataattggagaaatatttccaaaaatagtagttgcttagaaagaataattttcccaatattttatatataacattagtcatacaaataccaaggttaaaaacaatggctcatctagccttatttattattaactttcttttcttctttacttttcattctttctgacttctttctagttctgttgttttctggatcagatagaaaggctttctaaaggtggtcttcagctgaggttgatgtgttttagaatttaggattctgtcagtaccattttacttattttgtatcactgtttcgccaacatggtttaaattattgtttgtatttatattggtcttaatacagactttgtctttctgaaaaatctagtaccctaaggttaggagacttagctataattacctatttggtaagcaataatgaatcagtattgcaaatgttgaaaatctagctacccaacaccaacgaaaaatagtacacagttatttacttactattttattgtaattaaagtttcaatagactgccaattagatgaatgtatacaatacagacaaaatatagtacaagctctcagaaaacctccacaaaataaaaaaataagcaaaattgttggctacttttaaaaatgtattctacttgtacatttaaaataaacgtttaatcttcgtatttattatggaatggccctatggaaaaaatggactaagaatattctgtttagtatttttacatattaaggagaaaaggtcattacaatcattaagtgattatatatgtatatcattgggctaaatttaaccagccaactaatgtacattaataataaggtcatcagccagaagaaaaataatgacatttttggttttaaactaattacagggaatcaaagaatagttactttgtgtgcaactctttatggtactcgtgggatgtcaaggatatgtacagcagattgcctactgtctaagaatgtggatttcctttgggagataatactaacccttacggagaattttaataaacagtatacagcagtgtttactatttcttcagtggatggtcctcagggatactagaaaaaagcctagagaatcattgagaaatactgtcaatagtggaaaattagccattagtaagaagataggataggagacagaattccagaattgataatgatgagaaggtatgatgataatatatggattaaagtcagaatgaatggatttttaataaaattagtttggggaacaaaaattgagtgcattttaatttttgctttttcttcataaagtaacataattttatggagattctaggccctcagtagccaagcattcaggttagatatactcagtacatgaattattctattatgtggctgtgcctcattaaatactcatttacacaagtcagtgaggttttcccccatcactaattatgttttggttttccattatttattcattacttttttatcttccatgatacatcaaaaaagaaaccaaaacaaacagaacttttagattattattccattatctcaattcttttgctggtactacacaccatcaccatctcatatcattgtggttttctccatgtgctaattattgctgttttatctttgtgtttctgtgttatatctttttaaatccttttgaggtctctttctattctcctctacattagccgtgactcttaattaccacagggtcatatttagcaaatattctaatttacttgtcttctaagattcatatgctccctaaggacatttatgtcacaacacagataattaagcaatttataagtcctagaggtgtctaaattcgatgtcgggcaggggttaggggagtggaaggtggcatcagtttgcaaccagttacccaaaactgagaacaaaaataggaattaccataattccagatgatttcaaaggagcttgtttaatcattctctcctaacttcaaaatggcattatttaatacacttatgtttttaatactaacgttaggctaaaaccgggatttaatttctcttccaggaaactctgttgaaaaatatattttattgaaacatattgctggtttttctgtgagcaattatcaatatcttaattataataataattaattggatcagatcagtataaaaagctttgaaatgaaagcatgacaagtcatttgagaaaataaatatactattgatgaaaatgtcataacagaatggcctgttctatagtaagacatattatgctaaaatatgactacaaatttatttttaaaattaagataatttgacatcttaatttatcttatgatatcttgtttgacatcttatcacttttcagcttaaacacattttaaatatgattggtgtgtacttttggttatgtaatcatggttagcagactctatgattaaaataaatattgggcatggttgccaaaataaaaaatacttttttaaaaatgaaataattgtgttaaggcattcttttggattgaaggtaggtggatttctaatgaaaggaggaaattaaagggcatacaacttttgaattagaggatgggaagtaagtggtttagcctcaaaaatgctctttataatttctaagtgtttggaaatgttatctcttaaagccagaactatttcaaacaaaagctcagtcacaatgtcataatgaggaaactgtttcctaagtattagctgtactctttctgctgtcaataatctgaatatcaccagtgaccacggctgaaaataccggcagctataaattgttttatcaaatcactttttgaaattataagggggttgtaaacataagtccaagccccatgtgcttaagtatagttaagattttaaaaatatgtatcttttttgttttttaagacacaagctcttgctctcttgcccaggctgggatgcagtggtgcaatcatagctcactgcagtctttaaactcctgggctcaagtgaaccttctgcctcagcctcctgagtagctaggaccacaggtgtgtgccaccaggctcggctaattttttaaaacagtttttttttttttagaaatggagtctcactatgttgcccaggttcatcttgaactatatcctcaagtgatcctcctctggtggcctcacaaagcactaggtttataagagtgagtcacagagcttggccccctagaatatatatcttatgcattaatatgaaaaggaataattgagagataagactctaatctgaaatctctgaaactctgtaagcctatttaaatacattctactaaaaaagtagccataacacaggaaggaaattcatatatggcagcagaatgattccaagcaaaatgttagttacgtattcattggtctaagtgtttatttatatataggcaattacaaaatagtaggtttgggaagaaccaaggaagattcattgatttataatgcctagagacagcatcagctggcttcgatgtcatcctagtgtttttcatttggtttctttgttgttttatttgttgtgctgttgggtatatggaggtgatagatccaactctgtaccgctgtgaaatcaagaaacttactattcagtttgtgtttgagtaaataggtgccctattgaaacaacaacaaaaacaaacacagtagcacagataaagaattactgaacaaaggcaccgacaattgtacctcataaaatttgagatgaggaaagattatcagaaaattcgattggccacgtagcctcacataatggccaatagtaatggatgatttgttaattatttgtaagatttggtctactcagtatctgttggaatcccagtagtgatagacatcagtagtgtaactaacactgattaatcagtgaagctgtgcatatcaatgttgtgttttgacagtattgtttctttctttctctagagcagtgtttctccactgggggtgattttgctcccaggagacatttgtcagctctggagacatttttgattgtcctgaatgaatgtgaggggtttgctgtgggaatctagtgagtagaggtcagaaatgtgcatcctacacttaacgcaaccagaaatgtcaggagtgtagagtttgagaaaccctgttctagacagagatacaagagaaaccctgtgataattagaaggtaattttctgaggtgggatcaaagtaatgacttttaaattgataattttaagggagatattaaactgtggcttccaggttcattagtttcaggtacttttcttcttttgaataaccctgcaaagaagaccagcatgcatgagtaggatcatttggccttggcttcctctcttgtgtgtattgctgagtataaaataaaagtgtgacccagttttcttacaatttttggatgatacttctgattgggacttttttgttcagataagttagtatcacttatttggctattgccaactttttttttttttttttttactaggaagcagttgttcctttttaagatagaggataaaaactgatggctactggggactccagtcagcataattgctttcattggtgcattgtgcttatgaataattgaatttcatcatcttttgcttgggcatgtccttcccctcgctatagcagttaccatttcctgttgctagataccttcatatttatcttatttttatcattcactatgaaaatatttagatacttattatatccacaatatttatttaaaaatgattatttatgtttgtttacattatttaggtaatatttggaatatttccaattcagtcatcaaaataggatgtaacattgatgtacattcagggaaacaaatggaataatacatgtttcagcaaagattggacacctttctatatttagttagggaaggaaacattgaatctaccatagacatttaggctcttcaaaattttctgtaagttagatatatgtgaaagtgaattccagcatagctttaaaagtagtggtcattaaaacagggaaattagaaagaaaatttctgatccttaccctggaagtctactcaggcactattttaattaaaagtgtgagaggaaatagtcttgttgcttctatgtgtttgcaagtgtgacaggattaccctgcagtttcaaacagttattcatacagttccccataggtttaaagggctaaaattgactactacattattattttttaccctcaattaccattatgaaggatctagaaattagattctactaactaatttattcatgaggacaaagtatctcagatggtaggaccattttattgtcaataatcatagtgttactaataaatccacattcatagccatttattatgcatattgttaaatgagtaagtcatccttataaacaaagttatctaagtaatatataaataaaattatctgagtaatataaaaataatattaaaaataatataactaaattgtttccttcagataggaatacaattatgacaaaaattaattagatgacacttgtttaattatatgaactagagcttggttcaatcttgtctgacagagcctattagatatatgtgataaaaggattacaattccagtgttgatttttttagaagattcttatttagtctctttggagctggaggtgtcagacaggatgctggaaaccaacaggcagctagatttataacaactgtttgcgattgttttggaatttggcttcctgagaggtcagctctctgacgtgtatccagaatcagtcagtccatcttgagcaagtcgaggctctagtttaaacatttgatggatatttctgcccttcattttcttgctgaataattttatatattgctgtctcccagtcatagaaagccaattagaaatttttaaaaatactggccaaaggatacaaagtgtcagacagaaggaataataagctttagagaaacacaacagggcaaccagagttaagaataatgtattgtgtatttcaaaattactgagagtaaatttcaaatgtcttactacaaaaagatgggtatgggagctgatgaatatgttaattagcttgctttaatcattccacattgtgtattcttccatatatatcagaacatcacattttaccccataaatatatacaattatagtttataaactaaaattattaatacaaataaaataataaaacactcagtgttttattactttatgatggaacttaagcaaacaaaatacattttcgagaaacttttcaagctttggaagttgatgatataaaaataatttttcccttcttttgatctttcagaatacttcagtctacacagctttgatgatgtagaactatgcgttgccaaaacttctgcagcccttccacacttcacattacataatacagatattttaatagtatattggaaatatattaaattagtattttagtttgcttgtgaaacatgcgtgagcattcaaggaagttcaatttttggtaaacattaaatgataatgacagctcattatagagctagaaagcattttccctgtctcctacttcagttgaaatttaaaaaagtaaaaaatcaactgagacccagagaaataaagagacttgctcaataaatctagtgtagtcttgagactaaggaaaacatttcttgactcctaatccattgttgtttttaatattactagctgagaattccattcaaaataccttttaaagaaatgtgaaaataaataatgatcctttagttttttatatatataaaaatctatgtttatttgtggaatttttacttaaaccttttaggaaagatgcttgaattaaatatatgtatgtttgtatgtatttattcatatgttcacataatacagatagaatagatatctatgtatagatctatctatgcagatattgatctatctatatctatcaatcaatcaaccagtctatccattttactaccagataatcagtaaggaaacattatatagtgagtggaaaagaggaaaactgtgagtgtggtttacatagctttgtttgccttaacttgtctgaagtcatcatatttgtttttaacatattttaaatattgtgatgactataacctgtgtcatcattctttccatccaaatgttttcaattattgttgaaatattgcctcgtgaacaaaggataacaaccttggctgcattacacacacacgcacgcgcacacacacacacacacacacagacacacacaccccaccaagcaagcagcacctattattatgaactactactctacttctcttctttcccctgatatatctggctgaaataatctagtttatatttgaatttcttctgtgtcttaaaaacttgtagagatttttctacttctccatctttatgatgtttctgcatcattgttgaaatgactcattatgccttattactttattaatttatttgccaagtgttgtttggatccctgttgtgtgtcagataatattccagattctggggatacaatggagagcaagacaagtttgtcagactgacaataaatgagtaattcattgaaaatacaagaaaatgtcagctagtaaatttaaatccttgttgaaaaataacatagggtgaggtctagagaatgattagttgcttaggaaaggctcactacggagataacatttcaaggtcaaattgaagagttgtgtaggttgcaaggccagtaattacaaacaacatagggttcaaactatatagatctattccaagaacagaaaatatgtaagtggtggacatgggtagagaatggtacaagatgaactcaatgagataactaggggaaagatttatactgagttttgtaggtcaaggttttattttgtgagcagtaggtacactctgaagaaagaaagtggcaatacctaagtcatattttaaaagtacactctgtcaattatatggagagcattttctagggatattaaagtagaaactgagagaccattctgaaggctattgcagtggtacaagtaggagaagatgcagggtgtgaactatgtacagggatgctattggagaaggtaaaaagtaggtgggtggaggatttgcttggagataaaatgggtagggctttgttggttaattaccttcaacttgttggaaatagaggaatcagcatcatctctgaggttttaaatgtcattaaatgggtaattctattttgaatattttgccacaatttttgacaatggaatctatttcatggttaggtcttatatgtacatgtttatgcatgttttctgtgtataacagtataacagaggaatttttagaagcctggttgaaaaaatcttgaaataaaattaacaaatttataataaatagaacatagacatgcaatccattgtctcttggggcttaaaatatattatattgcctatgattatttgattcaatgactccataatattttatatgctttttctgtcccaactacaactacagctgaagatacaatagaaaataggagagaaaataggagagctcctgccataaggaaaacaggagagctcctgccgtaaggatctcattatgtattaagggagatatgcactaatcaaataattagatatataaacatttacaatttatgacatagaataactgcaaagtataggaatataagaatgaaagttaaatattgcttttacttttattgcttaatatccatgtcagaatttctaatgcattggctgtatctgttttaaataagtcacggaaagctttcctaaagaaatgaagatgagccgggctcaatggctcacgcctgtaatcccagcactttgggagcctgaggcaggtggatcacaaggtcaagagattaagaccatcctggccaacatggcgaaaccccatctctactaaaaatacaaaaattagctgagtgtggtggcatgtgcttctagtcccagctactcaggaggctgaggcaggagaattgcttgaacttgggaggcggaggttgcagtgagctgagatagcgccactgcactacagcctggcaacagagcgagacttcatctctaagtaaataaataaataagaaatgaagatgactgcagataagttgactaagcaagaatatggcttgagcatagtgggacaggcatgaggcatggagtattagaaacaaagaatgccatggtagtgggagcagcacaaggaagggggaaacaggttggagaattaagtagtggccagatcatgcgggtcatggtgctaaattttcaaaaatgatcagatttgcttttggaaacaaatatattcccgttgaagtgagaaagtaagttaaaattgaaagttgtggctcaagaaaggacaaataaagacactagtggatggcctaggcttgagattataagcaaatggacttaggcagtgccagcagagaagagaaagatttggacgataataataagtaaaataaaaagaaagtaacaaaataagaatgtagtggttggtgatggcggttagaatgatgtatcagggataattcttgagattttggttgtatgacttaaatgaaaggggagttaaccattgagatggggaattctgggtgagaaccaggtttgagcgtatggttggatgaaaatatctgttaaacggcatttagtaactaagtggggaaatctatcaaacagtatttagggtgtcacatttcttgattcaaatgtgaaaaatgaacctttaagttaaaaatagtctccactcctaggtggaggttacagtgagctgagattgcgccactgcactccagcctggacgacagagcaagactctgtctcaaaaacaaaataaaacaaaagaacacaaaacaaaacaaaacaaaacaaaggtagtctccacttcttaaaaagaaggagcagagttgtggatcatatggtaattctgtattagcagtttgaggaacttctaaggtggttgcatggatttgccttcctagcaatggtataagaggggcttgattaattcacatctctacaaaacaggttcttacctatttgattttagccattttagtgggtgtgaagtaatatcttgccatggcatttatttgtattcccttaatttattgatgatattgaggatcttttcttgtgcttattgatcatttgtatatctttgttggagaaatgtctgttcaaattctttgcccattttttattgagctcttttcaattgctgaattgtaagattttttcatatattataaatcaaattccttgtcagatacataagtttcaaatgttttctcccaggtatgttgtctttcactttctgattggtgtcttttgatgcaccagatttaaatgttgataaagtcaaatctattttttctttagttttctatacattgttaatttagactaacttctttttgtgtgtttgagaacataatagatttttatttctatgtttagttctatgatacattttgagtggattttttaatatgatgtgaggaaagaggtccacatttattcttttgcatgtggaaatacaattatccatgtaacatttttgaaaagatttttttttctgttgaataattttggcacccttctcaaatgtcagctgaccacaaatatatgattttgtcttgggactctgtattctattaatctatatgtttatccttaggccagaagttcagtcttgactgttgtagctatgtggtgagacttgtaatcaagatgtgtgagcccttgaactttgctctttttcaaaattggatttctgtgtcccttacatttccatatgaattttaagatcaactcgtaaaatttgcaaacaaagtcaaaagaagctaagacttttgatggtgattatattgcttatgtagatcaatttgaaaaatagtgctacactaacaaggttctgatctgtagacatacaatgtcttttaatttatttagatattattcagtttcttaaaagaatgtgttatatttttccatctaaaaatcatacttttattgttgaatttgttactaggtattttattgcttttgtggccattataaatagaattgtttactccatttcatctttaaattgtttgcagctagtgtatagaaatgtaatgatttttgtgtgttgaatgcttatcctgccacattgctgtatttgtttagtagtccaggctctttatactcataaggggttatcagtctgtagctttttccaactatgtctttgtctggttttgatatcaagataatactagcctaatagaataagtagcaaattgtttcttccttttattttttggaaaagtttatgaaggattttttttaatgtttcatggaactcactgatgataccattatggcctaggcttctttttcacaggaagttttaaatttatttcatcaatccttttacatgttataagcctattccaaatatatattacttctgaaatttatgtctttctaagacttcttgttttgatctaaataactgaatttgttgataagcaattttatagtattctgttacatgttcatttctgtaaggttgatactgatgcctcttctttcatgcctgattttagtaatttgaatcttgttattttttctcatccatctatctagaggcttgccaattttatttttcttttcaaggaagaaactctcagccttattcattttctccattgtttttttagcctagatgtaacttatttccacctaagcttttttatttccttccttctgcttgcttgtgttagtttccttgtttttttcctgacttctttaggtagaagtttaagctattaatttgagatatgtattttcttcttgcccttttttcttctttcttcttcttcttcttcttcttcttcttcttttttttttttttgacacagggtctcactctgttacctagtctggagtgtagtggtacaatcatatctcactgcagcctcaacctcccaggctcaagtgatcctcccacctcagcctcctgagtatctgcactacagatgtgtgccaccattcccagctaatttttttaaaaaaagttttgtcacactgtggtctcactatgtttcctaggctgatcttgaccttctgggctcaagtgatcctcctgtcttggtctgccaaagtgttgggattacaggtgtgagccaccacacaagacttcctccctcccttccccactccctcccctctttccttccttcctgtctccctccctttcttttcttctcttctatttttctttctttttgacaaagtctcactctgttgcccaggctggagtgcagtgttgtgatcatggctcactgtagccccaatctcccaggcttaagcaaccttcccacctgagcctcctgagaagctgggacttcaggcatgagccaccatgtctagctaaatttttaattttttgttagattgtgtcatactattttgcccaggctggttgtgaacaacttaccccaagcaatcctcccacctaggcctcccaaagggaggattacagacatgagccaccgcacatggcctaagattacagatatgagccactgcacctggcctctggctttttctttctttcttcctttcttttcttttcttctttctttttttcctctttactttctcactctatttcgttcctaatatagatttttacagctaataatttccctgtaagttcttctttactatatatcataaatttttgtattttgtgttttcattttcattcttctcaaagcattttattatttctgttgttatttatttcttgattcattggttatttaggtaactgttgtttagtatctatatatttgtgaatttcccaaattgccttccattattgatttttaatataatttcatttgggtcaaataacatactttttataatttcaatacttttccattcattgaaacatgttttgtggcctaacatatgatctcacctagaaaatatttcatgcaaacctcataagtatgtgtgtattttctgctagcatttctgtctgtaagatctttttgctttagaatgttgtttgtcttctattttattactgatgttctgcctactggttctatccattgctgaaatcaaggttttgaagtctccaactatttattattaaattgtttattttccctttcaattctataaatttttgcttcatatatttgtgagctctattattatgtgcatacatatttataattgttttatttttctgatagaatggcccttttattattgcataatttttatctttgtctctagtaagaatttttgccttagagtgtatttcatttgatgttagtgaaaccattctatccttgttttgtttaccagtttcatggtatacctttttcacctttttattttaaacttattagtgtcttcaatttagaatatatcctttgtatacagcatataattattttaaaaaaatttatcctgtcaacctacacattttgattcatgtgtttattttcatttaatgcaattattaataaggtagaacatatattggccatttatttaataatatttgttttctacatatcatatgtcatttttgtttctccattcttggatttctcactccttttttgttagatattttctgctgtatcttttatatttgctattgttcctttttactattttttgtgttatttatttagccattgccttgtaatttacaactagcatcttaatttagaaaaaatttgttcagataaaatactaatttaatttcaatggcatacaaacattattccaacttcatttcatgtttttcacccctttgtactgtaattttcatacaagttatatctttatatgttataacccaatcaacacgcttttataataattgtttttatgcagctatgttctaaaacaagtaggataagaaaggagttacaagcaaatgtgtttatgttttctttcataataactgtgtggatacttttactaggtcattttgtgtcttcatgtggtttcaagtgactatttattgtcatttcatttcagcctgaaggacttcttcctttagtgtttccttagagcggggctaaaagtaacaaatgctctcaggttttgtttatttagaaatgacaacttctccttcctttatgagagaaagtttagctcgatatagaattctttgttgacaagctttttcttttaatactttgaagacgtcaacctaaatctcttctgacctctgtggtttcttatgaaaagtcagctgttattataattgagggttccttgtatgtgatgttatgtttttagtgctgttttcattaatttctctttgtctaagttttgtcaacttgactatgatctatctatgtgtggatctttttgagcagaatttttttgagtagaaacttggaattttttgaacttcttaagtatatatattatgttttatcaaatcgagaaggttggagtcattattttttaaaacttgtttctacatatttctccttttcttctctatagtctttatggttttccttctttttaaatattggatatgtctcactctatacattatttatatgtgtctcttaaaatagtaactttaaattataattttaataaaacatggtctaataatctaaatattactctcagggttttccagtgacattttttaaaacaagataatgaaaacatatattgtaaaatataaatatttacactatctgatatgaagttcattagatacatgtggctacttaatttttaattaattaaaatcatgtaaaatttaaaattccatctttcagtcacactatccacattacaagttttcaatagctaaatgaaaccaacagctactacattgtacatcgtagagataaaacattttcatcatcacagaaatttctgttagatagaactgttgcagatgtatatatcataaaaaattcccccttcataactcagtacccatttttgaatgaagccatgtaaatatttgtatctgtcaaaaatcttctacagaaatatgtttgtatatatcttcatggatctatacataaacaatataatattctataatatatacatttatatgtgtgtgtatgtgtatatgtaagtgtatacgtctacattatatttaatttcaacagtacatatggtctatactttttatccacttaatgtatcttgaagagctttttatatgaacttttttaaaacaaaaaaaattgtgtaatagcaccataaagtgttcttgtatgatgtattaccactggtttaaatatttttctattacattactgctccaaaacaaacataaacaaacagcaaagcaggcatatttcaaatatatatgtaggctaaatatattccagtgtattggtgagtcaaagaaagtttatattgcaatttattagataatatcaaatttcattaatcaaacccaccaatagtgtatgatactctctgttagtccactcttcctgttgttgggtattgttcaaccttttagttattttcaatttggctgataaaagatagaatttaatccttatgttgatttacaatgatttaattatgagagaggttgagaatcatctttttatatgtgcattggccattgttgttttctggtgtttgaattcctgtgcataagtctttcatattgggactttgcaaatgacactcatggcaggaacattttaaaaaaatatttgtacttagtcttaatctaactggaattattcattcattaatatctgtaaagtccactgaaaggatgttctgtgtttcacatatcttaataaacctttatctgttgaaactggcctgaaagaagaaatgaatgaatgtaaaggaagagagaacaatgggaacagttgtgagtaaatgtctataattaactcattcagttataaacacctgtttaataaaattggaggaatcatctaccctataagagttggaaatattacccttaaattttccttcagtttttaaaatgaaataaaatgaataatgaaaaaataaacacacacactgaacaccttcttccagccttaggattaattcagcctctatttggacattgaaaaacatgcataaaactgatttatcttagcattctacacacttcacaaaaaaattgaagctattggtgaacatttctgagaaagtggacaatacaagaaaaggcttttggatttgggccataaaaatgcaagtttagtgcatgacaactcaactagtgaatgtctgcctcagctcctaagcacagttgaggagatcagcagtgtttgcagatgttcttgggagacagtaaaatagaacccggttcttacttcagagcttgagattttgctcaagacattgaatctggaggcagctcttgattgtttcttattgtcattgtcactaaattggacttgattttataggccttctttctttccccaactaagcagaaagtgccaccagggatgtaaatctaaaattattcttttcctttatttttgttatttgctttggcatggaagggtcatttatgatatctctgcttatcaaaaggatactgacaaataaacaggaaacagcaaatcaatctattattaggagtcccgaacaggaggtataatgttacatcggttaatatattcaagaaatattgatattctaagctgaaaacctgagccttgttattctttgttttttttttttttttccaagtgaattgcacattcagaatcttcttaatggtcagatccttatattttttgttgcttgcatcctgtatctgttataatttcatgttaaaattagaggatggagatattttagcataccaatatgctaagttgtaaattatgaagacataatgaaaactcttagttaacttagagaatgttaatgtaattaatatgtaaaaactcttccaaatcaattgaaaatgaacaaaaaatataaatggactttttatcaaaaaatattgttgataaatttaaaagctgcttaacataattcacaaacaggaatatttatcaacaagaagatagtatttttcacatatcctattggcaaagattaaccctgatgttaccatgtattggaaagactgtggaataatagagcctcttactccttgatagcaggaatgtcatttgtgtttttactttgggtaaaattttgtcattattgtgtgaagtataactttcacatgccctgtaatctaaaaattccttcctaggtatataccataaggaagcaattgcacgtgtatttcaggaaacaggaacagggaggtttattcagtcatagttgcaaacaaccactggtctcctcaactgtgcttaggagctattaatggatatttctgataaaatgacctgtagaatgcatggctttcaaccttggagaattaaagtgcaagtttagtaaatgaaaacccaacttttaaattaattcactatgtaaattatttatatccttgggtttctggttaatgtctaactcagtttgctttgatacatatatatatgtttgcctatatgatgtataatttaatcttagttggtcttgaacttttgaaagaggcatcaggtagtccatgatcatcttatacttccctttatcactcagcattttgttactgattcatgcatatttgcatttaacctgtagtccagttattttataactacaagatattctatttatgtcattctcttggttatatgatatgccattctttacatatattaccatatatttattgtttatcttacatttaaatttaattgggaattaaatttgtaattgctaaatctatcacgattgacaatacgtgaagagacaaaagctgcaattaatccaattcaagagagaaaatgataaggatagagtagatatctgtcttatctattaattcatatttgtcttatctgctaaatagatatctgtcttatctactagttcattttgtattgctgtaaaggaatatctgaggctgggtaatttacgtaaaagatgtttatttggctagtgattctgtagactgtgcgaaaagcatggccctggcatctgcttctggtgagggcttcaagttgctttattcatagtggaaggtaaagggcagcctgcatgtgcagagataacatggtgagaaaggaagcaagaaaaagagagaggacgtgccaggctctttttaacaaccagctctcatgagaactaatagagtaagaactcagtatgataaaaatggcaccaagccattcatgaggaagcctgtcccatgacctaaacacctatcattagagccccacctccaacactggggatcaaatttcgatatgaggtttgaaggagtcaaacatcgaaactgtagcaatatcaaatatggtatcactgaggaatatatatgaatatatcaaatctggcacaattaaatatcttttttatttgttaacctatgttttctcctattttttggaattattaattataatgctaaattaatgatgttatataaacctaaaatgagcctttgaaccatcagctgtcaagaagatttagtctttgaagcactactatttttctgtttctatttcataaaaagaaaattcagccatggtaaaaaaagtttttttacttaatattggacattatagtttcccttctttttgtaaatatgggaattgcaaagcttttggtaaccattatttttcttacactagaaataaaatcatattactaattgaaatacttaaaatatgcgtgttttaaaataataattatattatttttgtttatgaaattatactctgtaaaatgtgcctgatgggctatcagaacaagaatgaaattaagtaactttctactgggcagctccggtctactcatcttgtaagtattatgttacacacattgtataaggccatggtgaggaaaactcataccgaaattctaatgtcaaattttttaggacttccatagcttttatatgctgtattctttaatgcagctgtgcttgaaggtcacagcaccatttaaaaatatatatatacttgatataggatgattataaagcactaagacaatttgaagaatcattagaccagcacaaactgaacttcacataaataatttgcataaatatggaagttacaatatttcttttcttctttcatcagcccataacttttccaatttattaaagtgttgggtagagaaatattggcatgactctcaaattcaccttttctgccctatttttttaagttattaatagatttcagtgatcattaatttccactttctgcgaaaaataaaaattgctttttaaatgttttagtgtatggcctatgatgtaaatgaatagaatattattttggctgtttacatttattgagcaataaaaatatatgtgtgtcagtctatatggattagtaggtattgattcaatactcataaaaattacgtagttgtatcatggcattttctgcattgggttgttttattaaatactccaatatcaaaatgcatggtaacaagaaaatatatatatagagagagcatctattatgtttacaaaatatagatattgcagatgtcaggaaagagatataatttaagcatgatcataattaattagtcagctaagaaaagagaacatgaaaaaatacacagtaaaaaaaattgattttaaaattttctgcatatatagccagctatagctacagagaacaatcaagcctttgtttacagctaaattataaaagctatttgcttcttttctgttcttaaatccagacagtgaaagagagtgtgtcttttgcatcattctagggactgctgcctcctttcccagcttctcttgatttcccttttcttcttttcaactagatcgtaatctttttccctcttctcctccacttatggtccactggctttctaaaatccttcctcatgctcaaaccagggaatttggtcatttatggactgcactatgaaagaagcattttcataatatatacttaattacatgtttcaaaattaacatctttccaaaatgatagatggcttttctaaatatttttgtcaggtatcaaaaaactaataatgagattgagtagtgagggaagttataccctaaataaattaaacataaaggatggccgggcgtcatggctcacgcctgcaatcccagcactttgggaggccaaggcaggtggatcatgaggtcaggagtttgagaccagtctggccaacatagtgaaaccccgtctctactaaaaatacaaaaaattagccgggcgtggtggcgggcacctgtagtcccagctactcgggaggctgaggcaggagaactgcatgaacctgggaggcacaggttgcagtgagccaagatagcgccattgcactccagcccgggtgacagtgcgagactccatcaaaaaacaaaacaaaacaaaacataaaggatatgtgtgtgaatatttagggagtttgatgggctggaggttgagggagcagggaaaatatcataggatccaagaagacttacatttttgtctccatcattcactatctgttaaaaatgtacccatctatactttcagaattattcagccaaagctcctggagcatgatttttttttttaattttgtaaatagagatgtctttagatatttttattaccagcttattccaaggtctagaacaatacacatccctactacacagttcctaaggttctgccgtttctcaatgttaaggcaaccaagtcctttataccaacttgtattaattgtaactgcatctctcattctgccttcactcagtcttttctcagtctcaagtcatgcaaatgaatattttatgttttctgacacttctgacatttaagtttgtgtttaatgatttcttgctatgatctttaatatctgacatcttggaataccatcattatctcattttctacctctagttataatgtttctgacaaaagtgaatcattgtaatggggcctcttaatagggacattaccgtggcaataaaagatgtaaattgcagttccaaacaacctagaagtgcaatcacgaaacagtgatcaatggttagatgaactgcacgtgtaattaaatacatgtgaggtcagatgaatcacttgagctaagaaggacagggaaggcttaaaggagaagaattagaatgatccttcagagaaacacaatttgagtaaggaaaagggaaaggtgaaggtggtatagcaagtagagaaagttgaacaaaggtacaagaaaaagaaaacatgcacatttaaagaatacaagcaatggtacaccatgttcataactgcatgattactggcccacccggtagagcatgtcatttggggaacttgttccttttctttagagggcatggatttacgtggaacataaactttcatctattactctgtataaatgataaaagatgaggctttctggcatctctcttaaactccaggctttttatccacaaatcctgcacatttcctattggctatccttcaggagcgataacaataatgtatataaaattcgaatgtctaaaactttcctcaaaatatgcctgtttttctttattttctccagtgagaatgttacaaaagcaacattcacccaatgataaaaacttgaaaacctggagttattctgtatactttcttctttctccatcttcaaatctaatccttatttttttttttttgtattttattcacaatctcccctgtacatgtccctttcactctttgcctctgcttcttccttaactttgtaacattgctttcttggattgtcatgagcctcttaccatctctcatgaactcgagatgtcatcaaatctaactagtttttcacccagttgccaaggtaatagttctaaattcaaacctgattttgcttctttcttggctttcagttttaccacttatgaaaacagtaataagcactggcatattcatgttgacaataatgcatacttcatacataatagcagtaatctatggaatcatccctcatcttcccaagaattgtttttaagctacttgtgcattttttgaagtttattctcatattgtaggttgtaattcaaaactggcaagcttgtaggctccagacagaatctggcccccaagtatatttaggattgaatcataattttaaaattatgaaattataagttaaattttgctttctaacttttttgaaaaaaatggaaaactagcaatactgtgtatttttctataggacattgtatctggagctgaggagctactgtgctcttttaaataggcggtctgattactccgcctctctgtgattcttacacagacagcttcagtcttaccctgcttacccagtggtttcaagcaaccatgttttggacccttgctctaccagtgactaacgaggttcatgacatgcatcttatcctgaacaatatggaaagggaaacatcctagtgggtttggtttcccaactttgtagcaccttcagtgtctgcctgggggcttgttgtacagtgaatgttcaacacataagattcgcttgaatggaatgatacgtacaaaacaggcaccaccaaatgttcccaagctgccggaaaacatacatttgtttctctacttgatcacataccttgtctttcttgcttaattcatctagttaatcacctgcatatttgctttactctgtttatcatatcttgcttgccttcaacagaatgtacatagatggcaggattcatgcatttttatgccctttgtactattttggatgtcgaaaactggacaggcaggcatcattgctgagtaatggcaatgaacacatgtggaaattacttttgcatcctttcatttcaatagtaattaagttgttaaatatgaaggtactgtaatagcattattggcaataatcaacttccccaaaccacaatttgaagtcatattaagttgaaattaaaccagaactatttaatgtctacaattagaatcagtgttgaccaagatgtctcctgtggctgaaagaaagaataccccaaatgcaataaataataacattaaaggcatacactaagagggattgacctaagatttccaacatcttctggcgtgttgactaagctgccgagatacgtttcttattcgtgtatcatcagtaagtttctctgcagcatcagtgacctgcccacgactctttaatttcagagaagattcagcagcttgggccccggaaaagatatttggaaaatttcccagtttgtgtgctgcataagcttgaggcagtagagggataattaataaagtgccagactgggtaattgtaggaactgtaaaagatactaagacgttgttaccggaggcacagacgcacctgtgaaagcgtgaagttaatttgtgtgaggaacatcacatgagggtggatgaggatgagggaggtgagatttccttcaaattaattcagactttagtcagagaagctctcaaaaaaaaaaaaaaaaaaaaaaaaaaccctcctgctagtgagataatgtaaggcttatgaaaagaggccctcctggattgtcttgttacgtatgcttctctctgaccttgagaaaggtgtaacaactgcaacgttggaattttctaatccctgtaggacaagaatgatgacattgccctatcagtctttacataacagcgtaccatttcatactgtccccttgaacatttccttaaaaacaatacacctcctgatactataatgttggatactttgtgtatccagtgtcaccccaaattccccataggttaatttctatcaaatttcaatatacaataaagtaatgagagagagaattaggtcgtatcatagtattgccctgaagactgtttaaaatcattgataactgcaaagttcctaacaacttgcagaccacatggtagatgactgatcagtggtagctgctaatgttgttattttcatggttatttaaatggatcttttaaaaactaaaaaacaaaattcttgacatgaattgttgccagtgaatgttgttatcttcttctaaaatgccttatatgtagattgtacaagataggtgtaaacccccataccttagcattgccatatggtgatgtctcgctgaccattccattctcttgcatatctggctcaggaattaataacctatgtcattccaaaaatgattctctgataccaattgagtgctctacaattcaattcaatacggagactaattaccaggaattagcgtacacccacagttaaggagctcaattcccctggtctgtcctcacctcagatgccagctgccagtccctggtcccaatggtactgaattatgtccaacctggctacaaatgtgagggttctcattaccccttttcaggctggagaatttcttagaatgactcaaagagctcggacaagagctattcttatgagtagcagtttattgtagagggtacaaatgaacagctagatgaagagatatatggggtgatgtctgaaggggtccccagcacaggaggctctttctctttggactggggtacatcaccctcccaatgcatccatatgtttaccaaccagatggttccctcaacccttatcattcagagtttctaagcaaggtttcatcacttaggcatgatttattcaatcactggccagttgctgaactctgatctccagctcttctctcctaccagatcttagagtggggctgaaatttctaaacttgtaatcgcatgattgatgtgatctgatgaccagcttaatcctgaaactataagctaacgcctcccctcacaaagagtcctctgatgttgcagtcgcattagcatgaaatcgaataaagtgcaaagaagtttgctatgaataacaaaagacatttctatcatttaggaaatttcaagggtttttggagctctgtgccaagaaccagagaaaagaccaaatatatattttattataccacccaaacttgccaaatattgattagtctgaatttcttatcctatccattgtgttttggggtccctatgtaaaacaaacaaacaaacaaacaaaaacaaaacaaagaaactctgactttacacttttctggactttatagagagcagtcttatggaaactataaggtgtgcacaattgtttatgcacgtatttctctgcaaataccatgcaaagtatctattatgcttaaaattttatactatttattttgtgtttttttgtttctattttggagttttttcacacatcaactcaatgtgcttgccctctctttagacgtgaattagacaaatatctctatttcaagtgaaatcttttttctaccttgaatgtatttgtttcattgtgtagtttaaattccttctgtcctcaaatttgttcaattattagattataggctcaaaattagtcaagtacagtgtagtagtttttgtttgacatcaaatgcaatgttctgtatttgtgttttaatctgtttcaccctggggatttcctttaaagagagtctgtctttaatgttagtatctttttaaatataaacattcaaccagtaagaatacaaaaacacagagacagaaaattatgacaaacagaatgtcaatacttcttttccttttgattaatctagcatgcaaattataaaagcattttggttactcaggaatttcaataggcctttgaactttttaaataataaaaatattaacatattctttaagagataacatatagaaagatatattagcaaacctgttcttactgaaatgtctaatatgtcctctttaagctttttatattcatctgaataatcatacatacatacatgcaaatatgtatacaatataaaagaaatgagaatgccattttatagtgctatgaaaattgatttttttttacatttatacatccaaattcatgttaagaagtttttaaatataactggtttttttttctttttctaggtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaacattgattatggtcaagggattctttactggtatttgattgtcagcttggggttgtagaaaattttgcaaatggggcaagccaagcaattaattctgaacaaataaaatgttctaattgaaattagtgtttccttattccatgtgagccctaaagcacaattagagcaatatgtatggttgttgagtgttttgtacttaggtatcatttgcacgattaaaaagcaaagtaaatgttggaaagccaattcagcagattagtatctgtaaagaataaatgattggaaatcattcaaggacgtttatgagctttaagacgaacaataaaaatttatgaacttaaggcaggaagcctcatataatgctttgaaagccttttgaacacatggaatttcacagttcgaaagaactgctatttgatggctttagtcttttggaatatacatgtgctatatttttaaggttatattttttgacttaagtaatttatgctgtaaaagacagagggattttagtcaaaggcctcttttcctagtatagatgttggcctgttgtcttatcttttgctttgagttatctttattcattgggattttgtaagtcatatgttatagtaagaaaaatacttgacatttatagactaaaatattatgctaaaaagtttctaacataacattatctgaaaaatctaagcttgaaaagtctgctatattaaactgatcatgaacttttaaaaaatcaggtttcaggagctattgtaatgaagactggaactggcagtaggacaaacacatagatcaatgaaagagaagagagaacccagaaatagaccctcacaactatgcctaatagattgttggcaaaggtgcacaagcaatttaatggaggacagtcttttcaacaactagtgccagaacaatcagatatccataggcaaaaaataaaaacaaaaagcccacaaaaaacaaaaacatcatattggcttaagccacacaccttatacaaactcagaatggatcatgcttttaaatgtaaagtataaatctataaaacttttagaaaaaaatgtttgggatttaaggctagggaaaaatttcttaaactgtataccaaaagcacagtccaaaggaggataaactattgttccatgatagaccctgttttcaggctaaaaatacaagttacagtctagaagaaaatatttgaaattcccatgtgtgacaaaggatcaacattcatatataaagaattcttaaaaatgaacggttaaaaacaacaactataacaaaaacacaactatacaatcagaaagtgggcccagacatgaagagacatttcactgaagatttacagatggcaataagtacatgaaaatattttaacattactagccaataggtaaatgcaaattgaaactacaatagaatatcactacgaatctatcagaatggttaattttttttaagtgaccacacccaatgatggcaagcatgcagagaaactggatcattcatacattgcagttggaatgtataatggtacagctactttggaagatattttgatagttttttaaaaaactaagcatatatttgggttggttccaagtctttgctattgtgagttatgccacaataaacatatgtgtgcatgtgtctttatagcagcattatttgtattcctttgggtatatacccagtaatgggatggctgggtcaaatgatatttctagttctggatccctgaggaattgccacactgtcttccacaatggttgaactagtttacagtccaacaatgatagactggattaagaaaatgttgtggggtgggggagtggggagggatagcattaggagatatacctaatgcaaatgacgagttaatgggtacagcacaccaacatggcacatatatacatatgtaacaaacctgcacattgtgcacatgtaccctagaacttaaagtataataaaaataaataaataaataaataaataaaaaccaaaaaaaagaaatctaattataccacataaataaaccaacatttatttaaacattaaaaaaaaaactaagcatatactaccatccgacccagcaattaaatttcactggacaattccttcaagtcatttatcccggatacataaaagtattcacacaaaaacctgtatgcaaatatttgcagcagccttatttataatagccaaaaactgagacagcccagatgttcttcaaaggatgaatggctagataaactgtggtccattcatcccatgtaataaatattcagcaatacaaaggaacaagctttcaatgtagacagaaacatggataaatcttcggaattatgccaagtgaaaaaaaaacagtcccaaatatgattgtttgtatgatttcatctatataacattctcaaaatggcaaaattaaagaaatgaagaagagattagtagtttccaggagaaaaggagggaaatgagagcagctttttttgttttatgggacaacaagagggatctttgtggagatagaaatgctctgtatcttaattatataaatgtcaatgtccttgttgttttcttgacctggttgtttacttgaccaggatttcttatagttttataagatagtatcggtggggaaaactgggtgaagaacacctgtgatctctcagtattatttattataatggcatgtaaaaataattatgtcaaaataaaagattttaacttgaaaaagctgtaattttttaaaaagtcctaaaataaggcaaattttttttttttccggtgggagggaggccgagagtttcactcttgttgcccaggctgtagtacaatgcacgatctctgctcactgcaacctccacctcccaggttcaagtgattctcttgcctcagcctcctgagtagctgggattacaggcatgcaccaccacgcccagctagttttgtgtttttagtagagataaagtttcaccatgttggtcaggctggatttgaactcctgacctcaggggatccacccgcttcagccttgcaagtgtgagccaacatgcctggtggcaaaagtttttttttttttttttaattcagtttcaatttattttattaagtgtatggattatgcaagatcattgaaatcttttaccccgaacaaggtactggaaagaggtaaaaagatttaagtatgcatttccacatttatagttttatgcaaatctgatacagtttttaaagattagtgaatgaaaatagttaaaagtagtaaaaaatgatcaattattaaataaactagtgaaattagtttgagaacttttgtattcttgtccaagtcagttgatttctatctagaagaacaatttttactatttgttttcagggaagctggttaactgtctatgaaaagtaaaactgttttaggttatgccagatcatccctgatagtgtcacaataaccattctctaaacacagaaactgaaactgctttttcatcttatttttaaatagtaactttgtgtaatttaggtttatgtttttaaaatgtggaataaggaacataaaactaggttaactttgagtatttggacaaaatagggcacaaacttttaaaaatataattaacaatataaacataattatggaccagtcttcatattcttatggtcttttttttcttatcaaggaacaataaagatactttatgacaaaataactggaggtgaaagaatgctagcatttaaataaattttagaaactttatttcaccattttatatcatttcatttatttattcattttatttattaattatgtcccaggtgcaattgctgggctgtatattatagggtgtatttgtgggtatgctcacataaattgaattacctccttcaagaaatttataaccaggaagaggtgatatgacacaaacatttatatccacagcatacaacatcatgttatgtatcatatatatggtagtttcaaagaataaggaaaacttttactcagggtaatcatgttagagaagaatcatatgctgggctttgaagagcagacagctaaaaatgaatagaaaaacaggagtttgagaccagcctggccaacatggtgaaatgccatctccacaaaaaatacaaaaaatttagttgggtgtggtggcacacacctgcagtcccagctactttggaggctgaggaggagaatcacttgaacccaggaggcagagattttagtgagctgagattgactactgcactccagcctgagtgacagggcaagactctgtctcaaaaaaaaaaattaaataaagaaatagataaataaataaataaggcaagcagtcattctcactcttggctatggcattagaatcatctggagagttttacaaattgtttatgctgaggccctctcctgcagaaactctgatttaattggcctgaggtatagccccagctttggagttttacaaactccccaggagataatgtgcagctagggttgaagaccattgaatttaagtgaactgatctcttccacccattgaagactttccagatttcagaaaagggaaacattagaaataaaaataaaaacagctaattatttaaactgcatgtattttgtgccaaagtctttacttgtacacgcttaatccttatatcttttattcttaacacacaacagtagttggtgttattcttcctttattggtgaaaatacagagactaacttacctaatatgattcaagattgagtttttttttttttttcctgaaacagtgggtctcaatgtacatgctcagcatagcagcatcagcatagcctgggaagttattaaaaatccaaattctgttgtcccattgagacagaaactctaggagtgggcccagcaatctgtggtttgacaagcgtaagtgattctgatgcattcaagactgagaaccagtgtttagggacctgattccttaaactgcaagagcgctacctaagaagagagctacgcagccagaatctcaccatatgcaggacaaagattaatagaaaatatcatttaagagcaatgatctaccctgtttttctttagtttttcacaattatttcttcctggatttaacgtccaactgttcatttctgaccttggatgttgctctagtaacaaatttacccttcaaggttaatgtttgatctgttttcattataggtggcatagtggggtgtgcatggaagttggaagaaaatatgtgtttaaattcaaattatccatattaaaatttgtattgaaatataacatacctataggagcttgcatatactatgaagatagcttgaacttctataaaccaaacacctgtatggtgccatcacccagataaagcagcaaaacattgctgttctccattctgttactacgagccacaagggagaacactgtctacatttgtaaagattaattctgcctgtttttgcactttaggtaaattcacacactatgtactgttttgtgtatctcttattttactcaataattagttcataaaatatatccgtagttttcaagtattgtataacagattgtacattcccactatgatataccattccattgcacatatcacaattgatccactctactgttgattagattgtaatacagatgtacatgagcaatgcattattgtatagattatttgtctgatcactctctatttcccatccattactctgcttcttctttgacacctatttcaaaaaaatattatttaagagggcacaaacattttttgggtgcttagatagtgcatctgccgtggaagtgtgtttatcaatgtaaacctcccaaagtcccgcttcttggctgtttatatcatattttacagaggagacagacttagagatattaactaacttcctcaagggccccagttcacagttgcagagctgggagtgaattttttttcttagctccaaagtccctagcttttcgattactttgtcattttcagaaagttcttatttatctttacagattaactgtgtattttcctatttatttgaaatcatatcaactaattcctaattaattaattggaaggcaagtgaaacatactacaatatgtatttaataaacatattacaatatcaaacaatatatgattttcaatactcagtacttaatatacttctccagacatagtggttagacattttatttttgtatttgcatctttacaactgtttctcaaaatagtcaatgaaataatcattctggaatgccttttaatgccataaaattaaaaccatacttttaaagaagatgaaagcattccaaagtatggcaaatcatgatatgttaaaaccttgatgatcagaatatttgtggttaatatttgtcatctagtattttgatagtcaacatatcagactaaattattttttcagcattctgagtcatgtatataaatagttttaatttaaccaataaatctatgtaattttatatattatccatatatatttggaattattggtccattggaattatttaacaattgtatttttaagccatccttaaaaagtcaagagtcctttaccgcatttttttaaggacaaacatgaagtaaggagaaatcaatttttttaaaatttttaaacaaatttatagttttatagttttcttgtttggatttaaaatacaccatgtcaagtagactagttaactattttacactgtcaaccactttcttaatacatcttatgtttgttatcagaaactttaattaaatttactcttgtttcagcagaattagagctgtcctctatacataatgggacataaatctgcataagaattagctttttccgaatgcaagagtaacagttgaatgaatcctttaaatcgtgtctactagagggaacaaatcaaccgtagctgggctacatctgctatgttagtagtatctgtcctctaaattcgatgctctgcaaaagatcagcattgttattttctacagttagatgcattcatttcagtttaggtctctactattttatagctctgggtacagaattatttttctggtaagtatctattttaactaagaagtaatcctgtaaaatgcatcctgcatgcactactgctttaagaagtaactcttctctagtgaattatctaattaaagtctggaccttaatacttcagtgctttacaattacagatacatatttaaaaattctgggggagtacataatctggttatagaattatctaggctgttaaaattcatacattcggggttcactaatatttcaaaaaatacaaactcaaagaaagcacagtctgggaaagttactgtgttcaaacatgtgggactctgagttcatcctgaaatcctcctgccttctagtgcccatagaatactcacctttcctcgtttgtagttgctgctgctgaactgccttcctatgtaaccttctccttactacacagagatattaaggcattaaaaataagttagtatcaattttggaatatttcttttgggttaaggcaaaaattgaaaagtccctaggaggtggacaaaaaggaaggaaagaagtaaacacaagaaatatttttggaagccagtatttacaacattttttggtgaaagttactaatgtatttatcaatttatcactaattaaacaacacacttttatttatttttttattttttatttttttttattattatacttcaagttttagggtacatgtgcacaatgtgcaggttagttacatacgtatacatgtgccatgctggtgtgctgcacccactaactcgtcatctagcattaggtatatctcccaatgctatccctccccactcccggcaccccacaacagtccctagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattttgaataatgccgcaataaacatacgtgtgcatgtgtctttatagcagcatgattcatagtcctttgggtatatacccagtaatgggatggctggatcaaatggtatttctagttctagatccctgaggaatcgccacactgagttccacaatggttgaactagtttacagtcccaccaacagtgtaaaagtgttcctatttctccacatcctctccagcacctgttgtttcctgacttttttaatgattgccattctaactagtgtgagatggtatctcattgtggttttgatttgcatttctctgatggccagtgatggtgagcgttttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttactttaattagatcccatttgtcaattttgccttttgttgccattgcttttggtgttttagacatgaagtcctcgcccatgcctatgtcctgaatggtattgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcagatttctcaaagatcagatagttgcagatatgtggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcgatttgtagttctccttgaagaggtccttcacctcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacaacaacatacttttaaatagcatctttttattttgaaataatataactgtattatagagaatctgaaaatacacacacaaaaaaagaagatagaaataatgcctctatccacctccgttttttagagaaaaccactgttaatgtactggtttatctcatctaattcttatttattgttattagtatgtaatattttttccacttatagacaaaattataaaaatagtataacacagtttactatcatgaacattccactatgaacattgttccttgtcttaaatatttctcaaaaacattattttaatggctttaccatcttttcatgtggtgatatcataatttattcaactcaatatctttaatatttatagatagttgacagattagcactctcactattacaaaaatctgtcctgcaacgaacactaataaatatctgtctttgtttattctcagttaaattaatgagactgaaattatgggattatatattttttacattaattagtgttcttgatgcatattgctaaaatgcccactagaaagcaaagtaaatgtatgcttccccagtaaagagaaataatttaaggttccttttggtttatgatgctattttataggacacgaatgctttttctaaggtaaatgaacaaacataaacaacaaaattatttatggataggagaatctgtgatatgttagcaatttctgattccttcttacactgaaagctctgtgattcatattcactctctaagtgcaaatatctaagctcaagtcattgagaaagtaaacctattttaaaaaaaataaacaccttcaatatcaaataattgccttcattactctggtaaaattacactaggattaatagatgagtagaattagcaagcgatggagtaaaagtaagtttctcctcataggagttatttagtgagacttattttaaaactgttactacacaagacagtccttaattgtaaaacataatggagtcatcatttgtatctattcacaggtagtttatttctatagaaataatatcatgttctcattttaaactgcaagatgcaggttccaaccttcttctttagctttgcattcatttacaacatacaggtaaatttgaaacatgtttttagaattggtacctatatatacttgtattaagattatggactcttctttagttcagtgggttcctgcatgtgcctgttatttatttttactatcatgagataagtatctaagacaataaagcaacctatttccttatggtgtgttgactggcaaagaatccccttgcacatggggaggccacaaagtagaaataggcttagcatggagaaaaagtaaagtgagtccctatatatttggcaaatattaggttgaatgtgagttaagcagttttctctattataaggctttagagagattttaataagttagtgtattataatttatcaaatggaagaaaacatagttattgcaccctgactttacttgagacacatcactgtttttttttttttttttctcatggatctgtgtatggtctagaacaaaaaaacatactttgggcagtagtatattaggaaaatactatgatactaagtaaaaagatcttattctggtcacctaataatgacgcacatctgccgaacttcatgtcataaagcagtaatttattgtgatcatagattctgcagatcagggtttctagaagggcttggctgtacatttcccactcgaaggcttaggtgattgatgccagatgtgggggctgcagtcatctgaaggcctggctgagctgggagctatactttcaaagtggctcattcacatggctggcaagttgataccagttgttgactgagaacctcagtttttccatgtgtagctgtccacagggctacttccatgtcgtcatgagagggcttaaggcttcccccagtctaggtaatccaagggagccaggcagagtctgcaacactgtagccttgaaacccataaaccatcactagcactctagtgtgtgtcacacaggcacagctgtgattacaggtgggaaggaagcaatgaggccatgaaattcaagagatgagaatgactgatggctctctcccttgacacagatcctgaaacaaaggaagtaaattgcatgaagacttggaaaatgcctcaggaaatcacgatagagttctgaatactagttaggtgtagtgaggttaggtggctttgaagctggctgaatagccatatccagagaactgtgattaattgatattacatgtgagagcctccatggatcgatcagaaacctatattattatgtattattaatattttcatgtctgtttcttgttctatacactttaatgagtttaaaataaatagataaaagtatacttatcatagttttgaatgagcaaggtagaatagagggttgatttacagataatctatataatcaagattacagataacctaggggtggcaatgctgactggagttcaaatgattaaacttaacagtgtttagagtgaatttaagcatgcattttataaaaatctggctcccaaaatgtagcgtgaaggatagtaatggacacactaacttaagtaacgttattggccacagctcagtataaattcaggctgtcacattaactttaaaaacactgataaatttttaggttggttaataaaattaaactacctagaaccgtgtgccaatactgcagtcaccagccacatgtgtctattgaggacttgaaatgtgagtagtccaaattgaggtaaaaattgtacttcccagattttgaagacttaataaaaaacagaaaaacataatattaattatgtatcatattcatgatatgtttaaataatatttgggatatactgggttaaataaaatatattagtaattgatttaaccagttactctttattttctatgaacatagctactgaaaataagcttacatatgctgggtttgggttacatttctgttgctcagtgctgctcggtggatacaggaggtggatatatcagtgttctaagggcttattggaaaacacctgggatactctagccaattagaggctgtataggagacagtcataattctcaaagatttagcaattgtgatgaaggaattatgtaattgtggaaaaggaaaactctggaaaatatgggaagaataatagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggtgagttatgttgaaatagttaaatttcactgttttccattaatccaagaaggataacagttttacttctgaaatacatcataccataaacacaggaaaaaagagatgtgactttccaactaatatgtcaagtttgaaatgttgcagcttatatggaccttgatttttcttgctacaaatttcaatcaaagcagtagactttgttccatgtaatcgtatcttttttgaaaagtatcaaatatggaataacttttcagagaaccgtaacagtaataattcttagtagaaacagaaaacttcaagttaaaaaaaaaaaccacaaccagatatacacacagagaagaaattcagaagtaatatttgctaatattttctaattataccaagacagcaatgttatgattcctagttggagtttatactaattaattttcaattgttttcacgctgcctattttaaaaaggaaaacagttaaaggttgtgtgttagtaaattaaccagctcaaagagagtgtatagtgtgggggtctctaaatagaaaggaccttagtgtttctgaggaaagaagaaatgtagaatataattagccatgaggtcaacacagttttaaaagaccttggccagaaaatgaccaaggctttatggtcaaaacatttatactttatttttcacagcaaatttttgttaagatataaaatataatctactgtacttgaaatagactgaagtattgcattatgatgcttaattctacttacttaaacttcatgatgtttaattaaaattcacacacatttttcttcccttttcctcttgggatcatttaaggctaaaactggaacttaatctgtgaggtaaatccaacaccaagtacagtgtatgtgcacattatagtcatttgtttgtttctttaataattgaataagtgggggaaacaaagcttgtctatattgggagaaaatatgcattttctgcatcttcctaattccttttcaagagacttgtttcaaaataagagataccttacaggctgaggaaaagctagtggtatttgtgtgaattttgatcttcataaagaaacattaaataatctaagttattcgtgcataattttgcaccttaaactagttttgcacctataattttgcacttaaacttgtgaatactgtcagacaatggttttcatcatattttctttctggataaaaaaattctgtccataatatttcaaatacaaaaacattagcaattttcaatccaaggatatcactttgttattattacttttctcttcataaagaatagaagagcacttttttgcagttgaatttcatttaatatgtatgcctgtatagtaacacattctgagggagagcattttattaataatttacattttctttgtttgcagattgaatgatgccatgagaacaattaatggcatagatgttcatttactctccctcataatttctaagcaaaagcatttttgtatttattgaagggatgcaaaatacaggcatcttgtaaaagatactgtgaaaggggaaattttctaaataatgaatgttgttaatagtcatgatgtttatgtagaatataaatttaaaacctataattaggttattgtggattatacctgtatttattagttattcacttataaaatgaattgtggtatttgttttcagaaaaatgttccaaattatggggcaacatcccatgccccaaaaaatatcctgtttcctgttattggagagttaggttaatttaaaatttcccactattataaacaatgttgcgatgatcatccttgcccttaaaactgtggctgcatttctgataaatcactgtatcaagtgatattaattttgtagaggttattgaggcatattactgcatttcattccaagaagtttcaaacagcacttcctctagctttgtgtttatgtgtgttggggtgtgtgtatctgtgtgtgtgtgcgagagagagagagagatttttaaaatttaaccttttatgcgttattagttttgtggatgagataattgcatagaaagttcagataatttgctaaagatctgctggataataacagagctgggatcagaatcaaaggctcatgatattagccataacgttaacatgatctttttatgttaaaatactaggttaattaatcataaattcattcaataactatccatggaaagcttactatgtaagctttctcctgcactatatgccatggatatagcacagaacaaaacaaatgataatcccttgcataatagtggggagagataaagataaaagaaaataaataagtaaattacgtagcatgttacatggtggtaagtgctagggagacttttattttacattttatttcacttttacttacttttaagtacagactcacacaaatttgcaaatgagtatagagacctttgtattccttacccatcagcaaaatccccccagtggtgacatcttgcatacaaatagtgcattatcaaaaccagacaattgactagcataacataattcatacaattatagatcttaaacctgtttttgcatatgctcattttctgacatgcctttgtgtgtgattctatgacattttttattatacgtaactaccgctaccatcacaactgagatacagaactgctctgtcaccacaacgaaaatctcttttgcttcccctttatactcacatctctggctacttatctaatttctggcaacccgttttccatttctataattttgtcatgttaggaatgatatataaacagaatcatgaagtatataattttttgaaattggcttattttatattgtccaacataatgcccttaagttccatccacattgttttgtgtgccaagattttgttcctttccattgctgagtagtagacagtgacatgtaaagcaaaaaggaagatgccattaaaaagggtgcagttttcaatgcagtggtgagcaaagaggcattccacaggaaatgacacctaagtgtcgacctaaggaagtgaagaaagattcttgtgcatatttgtgggaagagtgtcctaggtaaagggaatatcctgagtaaaattttggagcagccaggaagcccttttggcctgagcagtgagagagagcacaagcattaagagatgacattaaaaaaaaaaagagagagatgacattgagacccattttaaagccctgtagactctacagtttgtggtaactgcagtaactgtataactatggtgattgtattaggtgactcaaatttcccatgacgttacttctaaactctgaagagattgaaagaattatcccttccctacgtgtgtagcaaaatgaatattttataatagaaaaatagtttaattgcaattttatcttttaaaaagatttccattttaaaaaatggaatataaagaactttatattccatttacgaaatgttgtgtcagtgttgtcaaacctttaagtaactttggcatgagacgggaagcatatattctattacttttcatcatccatgatttttactttgtgaaaacctcagttgggggatgcaaaaggaatagaatttactggaagaacagagatagcacctcgtatgaatcagaggacattgcatcacagttggggtcctcagcccagcagagaatatcacagcaaacactaaatagacctgccagaaaattccggtcttccggtccatttgggcagttatgtgatctaagtcaagtctcagtctttcactctatcaaagaataaaaagggtataagtcattttgacaggtctcaaaagcatcttagtaaatgaacaaagctcaggacatcaaagttgacgatgttaatcaaagactgaattgaactggtgcttgggggactggcagtcctaatctgattttcacaaacatgccaatatcaataaacttgcaggtaaacacacagccaaataaatagaagtgcattcatttttgctaaatactagatatttgatttctttaattctgtactatgtaattggaagcttacattttggtgttttacatgtatttctaacaccgcatataaactctttaaaggcagacacatgctgggtttttttttgtctccctcacatgcctagaatatagaatcagtatgtcttcagtcactagctgtgaaaaaaattcatttatctgacatcgaaaaacacaagtcattgcttttggttatgtgtgaatgtcgctgttgctgtaaataaattcagacacagtcaatgagcgttaacatttgattgttattccttctgcttataacaaagaactatgagatgaaatctaactgccaagaatcagtaggggaaagtagtcattgtgttaatttcaatgctgcggtgtaaatttcattaatattaaatggatttttatttaacaattgtaacttcaaaggggacaaaaaattaattaccttaacaaattgaaaagtcttcccttccgctgtacaggtaaggaaaataattaaagaaaaaaaaaaacaatcctgaagaaacactgactctcacatgcttattttcttcctgaaaatgtgagatagtaaaaactgaggaataaattaaaatttgcttctaatgttataaaattttgtcacaaaaaccataataaaaatgaaaatttcttatgatatttgtagaatattcaataatccttgagaaagtgtcaatatagtcagctttctggaattacaggtgtatgctgttgttatagttttaatttcttgtttttacatataaacctcctgggctaccttcagcatatgtgtccatgattgacagtaaagagttgctatttctgcaagtcttttcatgccgagatcaattttcccatttagtccatattaattcctaagtattcacatcttacaaaattaagtgagagagtgtaatctcaattgaggccatgggaaatatgagcaacctggtcaaggttttaaacctgtcatcatggattattttgtatttgtccctgagttcattctggcccaaaatctaactgcccatcctacaactacttagttaagcctttcctcccatcaagagtataactctggttataggctttaagtctggcttattttaagggtcaaagctaaatcaggccacttgaatttagactggtgtcactcgctgttcttaagggcaacataacatatggcattcaagcatatcctcctgaaaagactgaactttacctacagaggggtataaactgttcctcactgctgctggtggtggtgaattgatttcaaatgtagggttgcttatagttggaggatgtttccttttgctttattttggttcgtattttctgtttgttaaatacagaaaagaggctgtttatcctcagaaagtttttcttgactgctgcctaagttgttttctttcttctgggttaaagaaggttttctgggatagttaccgagaaatgacagtgatttttatgtcagaggggatggtagaatacctcgatttattactgaggcccaaaaaagtcaagtgacaaaaaaatctaggcagcggcagagtctgacctagatgatatgtttccaaatgctcaataaaagactgttgtttaaaatactccatgtcaatggcaaaaggaaaaattttattctctccaaaaaagttggtaaaagacagacatatatcttgatctctttcaaatactaattaccttgcatttctttcacatatctactcattcatttttaaattattaaatatgaggaaatgcggtaggtaatagacataaaaatagttacatgtaattcctgcctttcatttgaagagttcacagtgtagttgggaaaatttgtataaatagaagaattacagaacattagagcaaggagcaaagaaaagctccaaaattccaagaagaaggcatcaaaactgttatgaagattgggtcggagttttccaatatttttttctttttaagtgggaagatgccttcaggcatgtacagaacagagccatgaaaggtcatagtgtgtttgcacaacagtgagagacttggtgtggtaggagagttgggaaataaagtctggaaatcagaagtttaattcatgtatttgctaattattttcaatccctgaagttagctgtgatgaaattaaatcacaaatccccaaatcctcaagggctcataaatcctcaaatcctcactggctcacaaagactatatgggatttttacatcaggaaagagctgcctatttgttggttgagaatgctgtttttatatggcacctccagtcctaatgagtttcacaagatcacaggaagctacagagtctcttgtgcaccctctgacctaggacttgcagtaaaagtagatgtcatggtcccccctttatttaatgttttcatccttgatgctcagggcttttccaacgcattcttgaccttgctagttccgtttctatttgagaatggacaaaaaaggcaagaggaagctctgagcaacgcctagatttaggaatgactgaccctcttagacttaaggtctaaatctgcattcggatttgggaacatctttttggttttccacatctacaagacaatgacactgatgagttccattctctccctttccaattggccactaaaacatctatcaaaggtagaacagccactacctacttgatcagcttccagccagatgaaatgtcttttgttgacactgaaataactgaattatttatcaagctctgttctaacccaaaattacgtatgtatacgtaagtgtatatacatctacatatatatgtactttttccttatgcatattctgcagttgtatttgccagttgtcctcaatctggagaaatcaaaacctatagctaatcaatgggttcctttacaatgggatagaaaatgtattttctttcttttccattcatttaggtttctctgtattatatctaccaatttttctcaacaattttattcctcatttattttcatgctgataatgataactaagaggattttctactctctttggaatgagttagataatcatggtcctgataaaatataggtgttagggtaggataaaaaggaagacattgataattaaacttatcaaagaccagcaatatcacatgcactcagcttctttctttgcagatagtcaagagcttagggagtgttatttgaggaactaaaggtgtaaattctgggaagactcatcaaagttggatgatatggtggacagcatgaaaatgtcaggtaccttgggaaaacagacattttccctgtttcactattgtgagacaggtctttccagctcctcccattcttgatgcagaattgctgctctatcacatataaaaatgcaatttaattcaaatgctaattattgggtacctactaatagaattaacatccgctgagcctgacaagaaatgatatggaatccttagaagctatgagcctggcctttgaaaagtttataactgatatttttttccttgacttatttttagttgtgcgtattcctctttatccctgacatgaaatgtcacctagtatccatttccatcccagtattgccctacagaaaactctgggctctaagcaagacatgaatgataacttaaaattcccagcgaggtcattcttcatctttcactttgctaaataattgtggaacagtattttaaaagctatctggcaataacatataaagtagctttagaatgatgcttttgcagtcacagcactaaaacctttttttatgaaaacttcaagatttgtgcaaaagtcactttgtaaatgagagtatttaagacttccgtgatacgatggcagcttctattaaaacgaaaacaaaatgctttatctcattttgcaattttaaagtttgtttcatagctccatatcagatacacttttcttaaaatggcttataggccaggcacagtggctcacgcctgtaatcccagcactttgggacactaaggcaggtgaactcttgggctcaggtgttcaacacctgcctgggcaacatggtgaaaccccgcctctacaaaagaattagctgggcattgtggtatgttcctgtagtcccagctactggggtggctgaagtgggtggatcacctgagcctggaggtccaggctacaataaactgtgattacgccactgaactccagcctaggcaacagagtgagatcctatctccaaaaaaaaaaaaaaaaagacataaataatttcattaaggcaaatgacagaagagcttgcatattttctatttctttacatgtaagatgagcacttatctaacagtcttaagtagagttggcatctttccttaagttagatcaaaatcgattttgtttgtgtttagatattcaaatgcattttgcttaataacccaattagacttgaaaatagtgctagaataagtatgtgattttaacttttgcacaataaaaccttgattagctagaagaaaactaacaagaaatatcaattaaccagaaggaacaaaattataaggcaagctcaaaagaatctagaatttagaaagccgtatagaaaatgtggaagaaattatgtgctgaaggttataagcaaacatctaatctgattcctctgttttttatggttacataatcactgtttagatatttaaatcttctgggatcatttaagcgagttttctcctatgcattagatccttcttaccaaccagaaaagtggaataaaattatgacagtatcatcaacaaagactgaaagaaaagtttctgatgattattcaagtaactcgagtccagcagaacctctaattttcctggcattatgctaaaaatacatgcatggaggaggtgatagtattaaagacgagtttcccaggcagacagtttaggacacagaagtacagacaaggcctcggcacacacaggagtattctacaaatatcagtatagaaagtcagtgatgcaatgaggagcttgtataataggctttagctatattatcaacagatttcaagacccattattacttcaaacaataaagactcagaaaaagatacagttccttgcctccatgaatttaccatctaatgatggatgaggaaggagttcagtaattagacacataaaacagccgttgataaacatcataatgatgtttgatatgtccatgatataaacacatgtgaaatttgagacagctgtatattcatttgaaaatagcattcgcctccatctcaaatacaaatagtcttgcttgattctgtggaaatgtggcagtggcatcatgtgacaaagtttaaatatctgtgtaattatcctcttctctcaccaaaatgtaatgttctcttgattcttctatttctcttaaaggtactactacctatctaacaaagcttgaagccccggttatctttgtagcaccatcaccatcacttacccaattttgttttgatatcaaggaacccagctaatggttccactgcaaatacttaatcaggcctcttagttccctcctttgctatgattccagaagccatgtctctattactgccaggtacattctatgaaataatggctttgttgtttggatacattgacttgctgaaaatcttaaatggtccagtgccttctgttaaataatgtacaaactagttaccctgatatcaaagtctatacggtaggcctggagctgcctttctgacattattttctatatctgtgctgtgtttcctttctaccccaactgtgtgtgatcagtcttctcccagtccaacaccctttgtcctttcttgtgaggttaactgcactcactcacagatgttccttccttgatctccgtccctttctatccaactttttctatccttcaatgtttagtccaaagatcttatcattcatgcattctttccctattctctcatttcaagatgactgtttctgtcactgcactcttttaccactcctttggtttattataaatattggtctgttcattccatttccacaccaccacactagttagaatctctatctttattcaccgggattgctacaatagactcctatttgatctctatagccaatgtatcttacttcctctctagtccattctctgcatagaaaccagaataacttgtttaaaaacacaaaccagtcactggcttaaaatcaatcattgacaccacatttagaataaggtctcaatcccttaaagctctacaatgatatgcaagctctggcttgtctccctctctagttttgtctttatccaccgtccatgctccaggaacatttgatggaatgcatttttgagtgtattttatgccttcttacccaaccttcacacataccattctcccaactgcaatgccctttttcccacatcacacacattcctgagccaagtcactgtgatgatgtgattctgcttctcagaatatacaaatcaactccatctatgcagctcaggtagaattaattccactcaaatcatttgagtcatacaaaaagggggagagacagcttcctaaagggaagtccaaatgctataagaaaatgaaagaataaatgctagtcaggcaagagtgaaaatccactacggtcagtaatggctcttataaaaatacatagttatagaatctttaatatgcatgtgaagtatcatgaattacatagtgaaatatgcatgaaaaatgaagaaaactcatcattgtacatggcatgcgtatcatccaatggctaatgtagctgagttttttttgtcaagttagaaattttcattctcataccaatccctgtaacattgctattgtcattgcatctctgaaacatgttttcagaatgacagctataatgaaatatctgatgcttacaaaatgtgctcaaaaccatgttcatgggaatatgcatagcacattatttaaacagatgaagtctccagtgcacctcacaacccagaaatatccccttcattttctaactactttttcatgcagaaactgaccctcgttcttagtttttgcatgaaatttacagtagccatctgcttaggctgtgacctattttctttctcaacttttctgttaaagagaatcaactataacgcttatttaaaggaatgtgaataagctaaatatggggttgcagctggttcagactctctattgaaattctcatggcctggtataatttaagatctatttatgtaattgctgtgaagtcggagaaacaatcaaagaaagctgtgtgttacatcattttgccaaaagagatattgtgtttgtctccttgtttaaagaactgaactccgtagtagtaatctggcccatccacagatgtgcttaggtttaccctcacaatgttaatgcaaataatgactaaaacattcaaaatataatttattgtcaatatttaaaaattggggaattttatattcaaaatcatattccttttttttctcttgaaaaattggaagatctggcaatattggcatatggagacattttcccatggtaaccattggttcactctcacagatggggcattctctcttcaggtaaccttagcactcacaatttttaatagtttattcttgcagacttcacttgcttgtagtacctgtcaagcttttgtagacatttcagattgtaataattgcttgtcacaatgggatcctctcaaacaaaagatttggccaaaatgaatagtataaggagtacattgtgcaatataattttaaaattaagaacaaattgctcttgtgggcttggctatggctatgatatgggtagcaagaacttcccaagactgggctgtagttaaggctctgggtgtggcagtgaccatgggtcaagctatggctgtggatacagctgtggctatggattctctctccaatgaccatcaaattctcaaagctgttgatcattttgctgctaatttttgactttcaaacttttcatgcctctccctagtattccatgatgaatttcaagatgctcatgttgatttttcttacatttctctttattccttatggacagtgaaagataacatgacattccagtttgatcttctgcctcttgggcagtttccaatattttggtacaatcgacatttaagcatttgctcatatactgtcaaactatgggaatccaatgtatctatttgtatatatattttatttatcatacttcctaatgaaatgtatttacatttatttttaaaaaaggacaaatcactcaagttacaacctacaacaactagaaatcttttcagctacaagtacaagaaaactcaaacacagttggttaaaaaaagctagttattaatttcaaattatatctattaagtaggcagctaatttcatttgttctgtggctctacaatagcagccactgcgtttctaattgcccttaatctttcactgatgcctgtgaccttgctgtaagttggctaccatagttccaggtgtgccacacctattccaagcaaaagagtagattgaattaaacggcaaagggttgcattagttttgtttgcaccctttttatcaatgaaacaaagtatttccatgaagtactacctaggtgactttaattaaagtaaatccctgtccaagaggaatgagattataatgattcatttaaaacaatcataatttatccccttggaataacacagcatttgtcctctctgagattaagttatctcccagagttttcttagcatagaatctgggaaggaggtgaagacatttgtgtaggcaaaggacaaagtctgtcacacaagcgtctatgctcccatttactttcaagcaattttactctgaattttgtcttgtacttcatgaaggctccttccagaataattattgcctcacacggaattattatcaaaccaatcaatatttctgataaatgaggctgctgagctgttcattctgtaggttttattcatctccccttttatcttggattgcagtctaccttggcatgtgataggtattttgaaggaggtggaagatgtttctcagacgaaattattttaggatgtgataaaacaggggcaaatttttaataatttttaaatgtgtttttgttgacataaagagcacaatgcaatatgtattatcaataaatattcatcaatattcatcaataaattaaatatttattaatgaaaaaccttactcagaaacctcaagatcatgatttaggctgggatagcattaaacatgtattaaccagagacataaggcagggaagaccaaatatctcaataatctcttccattgctttaagttattcttcattctttgattttagacaagaaaatattacacaatttatgcaaaagttacactttaaattcctagattttgaggtcttaagtttgaaactaggtttattcagctgtggtgactcaaaagaagataagagagtggaggactcagacaaaaacgtccctgtagttgtcatcgcctagcctgagaaatgattggatttaaaaggaatttactatgctgaaagcaactcagattaatttaatgtgaccatttcaatgtacactcttgcattattcatgtactatctagatattattattttttatgcaagtctacagtcatttgactttcaaagtatatcctgtagatatcctagacctgatacacttggtataaattatggaattacaccataacattaccataaatctttatattcaaatgcagattgtgtctttctccatagctattcttcttgctcatctaaataatatgaagccaatgtaaattagattcataaatgaaaattatcactattttcaggattaagaagtatattaacatatattaataagctgttttcaaatctgtcatttcatacattatagtttttctcaaaaaatgtgaaacttttttatttgaaccttgaatgaataaatataatgatatattaaattagcataaaatattctgattattgagtataatacgttttcatggtcttcctacaagaagaaaaaaggatcctaattagatcaggacattgattaaatgcattagtgagtaaactgaagctagtatttactgaacaaatggcatattatactttatctgcactatgatctttgtagcaaaataatctattgattgttttatatagaccacaccacaaccatgatttggattcatggctgtactgggaagatgcttatatagatgtttcttttggcactcaaaattatgctgagggttttttttttcttaaatgatttccttagataattcttattatactattcaaacaactttcaaaataagtcactgaattatttaaactgaattattcaatgtttcaggtgaagtgaatactggagagggccagattcaggttagcttctaagctccgacacctatctctctctctctctttcacacacacacacacacacacacacacacacacacacacaccaaattaacacctttctccaggcccataatcactgaaaaaccctatcttgctttaataccagtgattactaaagtgtctactcccaaaactactatgtgttctacctagaattttgaccctacattttacaagtttcaggcagttaaaattggtcataattgctgaaattatgtcacatgtgaaaaaatgggatgcaaatcacagatgtgtccttatacctgtttactgtaaggacagcaagcagagacaagagatagagacaagagaatcaagtttctatttttagttccattgtcactgtcccccaccaagacatccatttatcatttctgaggacaccagcagcaatgttattcctgggtttacaagtacatctgaagactaagaatttgttcttgggcaacatcactttgaccacctactgatttggggtagatgcactaaataaatcaaatgcattcattaaatcaaataaatcattaaatatattgattatagtagccccagtctatgctgtgttcacaaatccatgctggtatttcaggagatttacataatctcataccccaaaggtaacaattattaatggttgctcaggaatccttccgaaaacatctttcttcttaagcacacatacaccaacacacataagtcttttaaaaatacaaaaggtctgtatactctgttctgttctgcaggcagtcttaataattttcatgtaatatctttccatgacaaaacacaagtacagggctcttctttttcatcatatcactaaaaatatacatttccttggtttatattgtagtctcttccccttgtgcaacctctgcctgttttactgaacaaatcactcctgacacattgggttgagttatctgctgatgtcctttcccataaatgttcccttctaatacaggggcagctctaaatcttaagctcctgttgagtactgggagaaaatatctaacttctgcattaatatctaggttttcacacctctaaactagaaaggacatgactatagcctgatgtcaggatctcattacttttcttctcttactttggtatctgatgttccaaatggatattgatggggaaatttatttccaatttaagaatcaagagcaaaaattcatcttctagaatatattatttcctattttatatgctctttcctggaaacttagaacatgtgtagaggaggaaaaactttcctctgccctcttacgtttggagctgtggcatgtgaattaaagcatacaaattgtattaatgtttttaattttacatgcattggaaccacacagaaaagaagtgaaaaacctaacggagttattagactcaggggcttatatactactttaacaaaggattatatatttcggaaaatgactaggaaatatatgggaaaactacgatgagaagagttatttagtaaggtttgtttatgcagactcatctctcagtactatctttatttcccgtaacgagggtttttgtcttcctgagatgggagaagggaacatttccacaaggaaaactaatgtgatacttgtagtcagaaagtgggagggcagagagctcttactgtttctgatttctctcaattaccttcagttataaaaaatcattttccaaagtggtatattttggtgtggcatatttggtcccttcatatgattatgttccttttttctatctaaagatggtatcccctaagtacatccttgaccttttttaccttcttatattagcacttgaggaaataccaaaaataataaatcgtataacctattactgatgaaatgtgtatgtttctttttgtcatgtatgtgtggtggaggaggtgcatagaggatatttctctgtaacttctagcttctttattggcaagcaaatagattggcaagcaaatagatttatttctgtgtgtgttttcaagtcattgtgattagcatggactacctttgaaatagccatttgagggtccccagagtctataatttttgaaataggaaaatttcaggatattagtatttttctgagtttaaaagcataacctaaagttaacttgtaggctttttctttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgtatgtggcccaggatgactttgaatgcagcccaacacaaattcataaactttcttaaaacgttgtgagatttttttttggcaggttttttttttttttttttctcatcagctatcgttagtgttagtgtattttatgtgtggcccaaggcaattcttcttccaatgtggccaaggaaagtgaaaatattggacatccctggcctagattgtgagaaaagagatcccattacatttatgaatgggctgtgctgaaaattgacagcaacatcagaatcctaattgtgtgccagcagaaacagtgctattagattttctctgtgcttagcaaaggatttagttagggcattcactttcaagcacccgttctatgcattacacactctcatactgtcttaaccaataactatttctataaggacattctggtgaaattagtgtgtccaataatttaaactaaaatggtgacatctaatattttctcctccaaggtaacgtcagcatttcagagcactttcactatctgaaaacggccaaaaactgatagaagagctttctgtttacaactttatacaccatagtaaagttctaggatgcaaagcttgcacagctttgtaacataagcattttatgccaaattaggtgaggataataagatattgtgacatttgcccaaagtcacggaacagtacaaaactcaagatttgaacaataatttttctgactacaagaatcattccatttctgctggctaaatcaacaatgaaatacaatagttttgcattgcgacttagaggtaccccatgtattccactaaaataatttgtattttgttagaaattaaaatataaccacatgaaatatgtctgtgggtgtctctctctccctctctctctctgtacatactgaatttctaggtgtaataaaatgcggtcagaaagagttcctgcggtaccacattatttttttctttttgcaacatgacactacactacttctaagggctaacaaattttaaaactttcaaaaaacatgatgagaaaattgatgaaagcctaccatatagaagcaagaaggaggtttgaagtgcctttcaaaacagattaccagtctgtcattttgacaccacgtaagatggccgtagaattatccatcatcgagagtttcttcatcaagaaccctaccctccatctgtatagagcttgcaaactaaagcactgccttgttcagagtcttttctattgccttaaccctgtcttcttgtgactgcctttctaaattccacatgaaagtccctttctcaaggtataattttatgtaaacttttgagctgactttaagatttgtgggcatattgtggaaatactcagacatacccagcacatttttccagatgttccaggtgttccagaggtcacagctccatcatggattacaaggcttttggtaaagaaagatggatcaaggttagagagtaaaaaaagaaaggcctactcctatttgtcacttcctgtgaaatgcagaggctcctacctaggaagacatttttcaggtgctgagaggactcttgggattttatttattgtgaaagtttcatttattttgaagtatcattctaaaaacaagattaatgctcaaaatggataatcaacattatctggtacaaaacacatggacttacatgttaaaggtgttgttctttccttatcatctctgggaacttggacaagtcaggtaacgatgtatatattttataagacaatatattgtatacattacatgtacatttgtgtgtgtgtttatgtgtgttctctgagaagcagacccaaaatggtacttgtcctatttcaccctgaaaacaactcccaggagacacatggcctcagcatgaacctggcagtggattcagaggggcagctggatccaccatgcaactattggtcagccgctctccataacaggatctcttgaaggagatctaagtaatgcttttccatgtgccatagtgtatgaaatagaagatctgcacataatttagaactatgagagaaggtagctctgtacattgcaaggactcctgaagatctcattcaatgccgtcattgaacaatggcacgagcagttattaatgaaaaccattggtcagagactttaaaacttcagggtacccaagagtacatttcagcgtttgctaaaatgctattaccaatctcaggaattaggatttaatgaataagtaatgaggatgaattttaacaagcaatcaggggcatcctgaactgggtggtctctataccacagtctgaaaagtactgaccttcctaagcgatgtagaacatacaaaactgtactcattatagtatattctacttaagtggattatgtatgtcaggttttcatactaaaaaaaaattactctggggaattaagagttattttcatttattcagaaaatcatatatagtctatgatattatacaactgaggcatcaacaaataggtaatttttatgaaagttcagaaaggcagtagggacttgtaggcatttggagggcttcattttcccatgtcaattggtatctctctgttacagtaggtgccattatctactttaattgtaatgaatcactgggggaattgtatttgtgaatgacaggtactttcttatgcaaatgaattgcccgcagtgagctagtttagttgatcaagctttccaggtcaagtagggcatttcccagatatgataaataaatatcttgggagctaaagaggaaatcattacagcatatcattctatctgaatttcaaaaagtatttttatatttaatttgttccccaaatactttccagattgactatatatactatttcttgaaatattcactacattactgaacactatcatttttgtgtcattcagcctcacagaaatgttacccaaatgggatgagtgctccagtgaaaatatgaaagccatatgaaaggcaggttcagtataaatgcaaattgctttatcagaaacattgtgaaatcctccaaaaggtactaatttaaagttagtagaacacttttaaagtggcttttaatgtcaatatccctgtaattgtcagtatcctgaaaatagtaattatgacagaattataatttaacaacagtagctttcttagtttgatatatttgagtgacctaattaaagtcattcttaattgttttaccgtttgatttctatgttacaaacttgaatgagagactgctttcttggtgcttagttaatctaggataatattaataatattaaaataatagaatagaacattagacttcagttttgtttctattaataatcaaagttattagtttgtggtttgtatttttgttttcataactgtgtgaatcatacatttattttccaaattatgtgcaacctgattgaggaccccttttaactttacagccaaagtacccagatggcattctgaagtatatcttacaaataacaaggtcaaataaggaggatgcacaggccatttgacagatataatttgttaaaactttatgtttttgtggaaaaccttataggaaataatttctaatgttctaatgtaagcttatgttagatactctgttagacattgtctaccaagcttccatggttttagaatcctgattttactctaactgtgggtacttacatatgaatctacagagaaaagtcctttctcctgtgtgaactagtagggaccaacgactttaaattctctctctaagacttgaggtcgccgttcaaagaactaactgctgtcaaagagcccacagtgtgttcattacttttttaagatacgacaactttgggaggctgaggcgggtggatcacgaggtcaaaagatcgagaccatcctggctaacacggtgaaaccccgtctctactaataatacaaaaaaattagccaggtgtggtggctggtgcctgtagtcccagctactcgggaggctgaggcaggagaatggcgtgaacccgggaggcagagcttgcagtgagccgaggtggtgccactgcactccagcctgggcgacagagcaagactccttctcaaaaaaaaaaaaaaaaaaaaaaaaaaaaaaaaaatatatatatatatatatatatatatatatatatatatatatacgacaagctactgatttaagggcaaggaggagacgggggaagtatatttacaatcttcaaaaattatcttgtggatactgaatacctaaaaagaaaagctcacagtgatctattccccccacccccgacctcccacctaggtagtttggtagtttctgctgagatcagaaattttttttttattctgagacagggtctccttctcttgcccaggctggagtgcagtggcactatcatggctcacaacagccacaacctccagggctcaagctagcaaagtgatactgttagcattcaaaacaaagaacaaattagtaatgggtgttttaatattaaactcatcttactgtggtcattatgaccattaactcttccgtacgaaagtattttgaagtgaatcatcagggactctgagtcagtggtcttgtcttgatgtctcacaacatgggtgcctctatttatttagacatctatcttcaccactcactttcaagtgaaagtgaaagagcaggtcatcaaatttcagtattctgttattttttgcagtcgggagccgtatggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgagacaggagaattgcttgaacccaggaggtggaggtggcagtgaactgagatcacaccactgcactccagcctgggtggcagagcaagactccatcacaaaaaaaaaaaaaaaaaaaaaaaaaaggaatctcaaggattgaaagactgacccattgcggtgttatcacgtccaaaaaaagtaggcatattcacatactgttttgagagaattaggaaaattttatgagaaagttatttggaaaacatacaaaattaaatgtatttttccactcattttcaaaatgtactttagcacaagaggcctggtgcatagtatatatgagaagtatttaaatgaagggatacattttgtatgatttttcttacaaattcattaaagtatttcaagtaatatagaataattatttaaccagtgttgcaatggctattaattttccttatggaaggaaaatagacaaagacgtattattgattttcttcttaatctttttaagtttttttaaataaattggaaaaatacaagtttatatgtagatttacttatatttgggggtttaaataaatgttctgcatcgctttgccgcttctcaacttgccccaaagcaaaacgaacacttccatggtgtctcttggaactcctctcctttcatctcccaaactgtcctatatctttgaagtcgtttctgaatatatgcctcatctccttcctttctgtgaaatctgacagtttgtcaaaaacacaaccctggtagccttttataggtgatgacaatgttttattccatttcccacatgttatagagccagtatataaagtaggtgctttacttgttcctcattgctacttcaaagtcatatctcaccttttctgcttcaaaaacccagaatgtttgaagctcaaagtcatcgggctgtacaaatccttcccccttttcattgttataacccactgacatttgtcattctctgccattcatttaaggctgtagattctggctcgctctttctcttcatctctacctctgcctctattctagtcaccttccaaatccacgtggccttaaaaccacaggctttcaatcccttgtcttacttgtctccaatatattttccttcaccctaactcagatgatcatttaaaggttgagaccatatgctttttcatcactcttatcagcatccccctaagatcaatcatgattccaaaagttccacactcattttttctgtctcctgatccatggttaaaacaacctcacatttgtcaattgtttttatctctttttaccctctatcatctcctcctattataataaacatagattaccagtccaaaattataatcactttcttgcaaacaaccttaactattttacctttgtctttttgaatcatgcttatctatcaaatctgggttttattcagtcatttgcttatttttatctaaaacataatctccccaaaggtacacttatattactgaaaaacactatttcagtttcctactctgcatgattattttatatcttctattgtctacataagtttaagttggctttatcaaaagcctttctgatctccatagccaaggaagttccatagctattgatttcaactcattggtactgggtgatcacagggaatctcagtgatcagagattaggtaataatatcttcccggtcaggaaagtttgaagccagttggctatctttctttctatatgacagttattcatacacgaaggtgtgaaattttcaactacctttcctggaatataattcatgggtatgtatcagtaacaatgtatgtctccttttatgaacatcatgggcaaagtatgaaaacaaaacaatcacctcttaaacgtgtcaatcagttaccatagccaagtgcactgtgacattatgattgtttcagagcggggagcatttgctgtgcatcattttatcctgaatgtttttcctaaccctgactcatggtagtcgtcctcaatatgtatttatttgaaatgtatgttttattttcctgttagatctcgtaaatatcagacttccgaggacataaatctgttaaagccttgtctcatgtttattgtttttgtgtatctcttaaggaaatgatattttgtttttatattttctgatccgaaaagagcaaaagcccctgcactcgagagagctgttacaatcaaatgagaaaatggaaaggcaaataaagaagatgtgattccctacagctgtgaacagtgatgtggaaaatatagtggcttttaggtaatatagggattcacatcctgtctctaccacttactgcttgtgtagcattgtaaaaacaacactaaatctctctcagataattaagacacggaatctgaaacacagtgggcacttgatacatgttatccctttttatactcctacctcttcgtaaggaaatatttctgagacagaataaagttcagaatcaaagtaacaagatgcttaagccattttgacagaaaatagcaaatatgtggaaaacataacaaaatatcaaacacttatataggttaagggggatgtgcccaagagctggaagaagagagattttctctataaatgattcagctaagaaattatagaatgataatatgaagctattcatctgtattcaaatttttatctaaatgcctaagattgacatgcaatatatgtttgctcttaaccatttgtaggaccttgataacatttaaaaataggtttacattcattcatttcactctccaccacattctctttttgaatctctctctctgtgcccccttctggaagcctcttttaattacttttacagagtggaaattgtatttgttaaaatatgccagccctcgatattcaaataaacatattccaattatggaaaaatgtgagatggaatatatttaataaaatgaggtctctaattattttttcactgaaatttgatcatgtcttttttttttttttttggtcttagtttttaaatgttttatttttattttatttttatcctgactgtctgcatcctacttgctcaggtaaaaaagtaagacactaaaacttgtttaaagataaactattaacaagtgttaacttaaggaaacttctagaatattttccatttggaagtctatttttcacggaaatagagccatgttgtttatgttaatttgtacccagaattttctgcttactgaaacgtgatagaaagttctatttcaatacacatatatctaactacatcattcattttcaaagaccttgtggtattccaggatataaatgtaccataatttatttagctaatattcttgaaactttttgagatgattcaaaatcaaatgaatttttagtcataacaattctctgaacatttatcacacacagcctagtgttttcaattgttttactcaaaagagaaagtcttgaaaaaatacatcagatggtaaaatgtcaatttgaagcagtgttttccacattaaaaatattgacatttttctctttgccaaatttaactggcaatttaaataacatttctgtattcatttgtcttttattgatagaagaatcaatagtattagtcagttgggttagagtgggaagagctggaggtctggaggcaggtcctgggcttagacgtggcctttgatgcttgatgttcaaatgctaaaggcattttccctgttttcattgggagagggtgagtgattactggagtttctatattctggcaccaactggccttcttatttcctgtgacacggagagcaaaatcatgaaaatgttatataccagaagcagagaattctctcctacctccaaaaagcagaagttagcaaacactgagctttgtgcgtaagtatgtgtgtatatatgtatgtaggtgtccctgaagataatttacatttttgttttatatgttttgaaactgttgaatttgaaacaattttagtttataagaaagttgcaaaattatttaatgaaatactataaacccttcacccagattctctttcactatgttttatgtacatacacatttacatacattaatatatagctattttttctgaaccaactgagaataagttgcccacattatgcccttttagctccaagtacttttattgtttatttatcaatggcattcacttaaaaatcataatacattgataaaaaagaaaattaatgtacgtaaaatgttatcaccaagactagaggtcatattcatattttgccaattgttctaatgtcctcaaggataaaaaaaaatcctggtccttagtctaatctagattcacacagtacttttatatggcatgtctgttttgtctttgtacatctagaatatttccataatctttctttgtggacttgatatttttaaggagtacgggacaattattttatagatgctgctccatttaggtttgcctgatattatcttgtgattaggtagaggttatgggtttttttttttgtttgttttgtttttttttgtttttttttgttttttttttttctttgatggagtcttactctgtcacccaggctggattgcagcagcatgatcttggctcgttgcaacctccgcctcccgggttcaagtgattctcctgcctcagcctcccatgtagctgggattataggcatgcgccaccaagctcagctaatttttgtattttttggtagagacggggtttcaccatgttggccaggctggtcttgaattcctgacctcaggcgatcagcccgcctcggcctcccaaagtgctgtagttacaaacatgagccactgtgcctggtaaaggttatgtatttttgacaataatactatcgaagtgatattgtgtttttcaatgtgcaacaaaccaggagccacataatgtctaggggttccattaatgatagtagttacttagatcatttgattagggatagtgtgattttgtcatttaaaagtatttataattttctgtatataaatatatcttatatacgttttttcctaatgtttggcatccactgagttttcttgactgaaaaaatttatgatttttttctatatggtggtttttctcttcatttttttctatgctaattaattactgtaacaaagcattttccattctttcccatttattcattcatgtgtttatttatttatttatgttactatagactcgtggattcttattttatcctatgtcttataacatattactattaagattcgttttgatgatccaattttctagatttggccagtgggatccagttcaagctggctcctgtgtctttcaaaaaaagtcatcattctaggaacattgtcttattttttgttactgtaagtttttccaggctcattttgaacatatcctgctccaattcaagaatgaagtatttatccagtgtatttccttttagtaaagaattatattaaggcatcaggagctggtcttaggtatgctcattgctactgtaatgacgtgtacatacattttcaaaatatatttaaagacactttccagtatctgtctctagctctttattataatccattaattcataggatattcccattctcatttaatattacagggtttaattttgccatcatcctttctgtgtttttatattcctactttaacattgagaaacctggattccattacccataatgtatttactatttcctcagccttataagagacgtaagtagtttgaaattgctaaattgtgccattgtgaaaagcaaaccgactcattacatttcaattaaaaatttactttaatcagagagtatatgtcaaagtacagatttcaagtactatttggtgtcttttttttttcttttcagcacatcttgactattaatttgaaacacggtttttctcccatgcttgtagattccagggatttgtttttatatgtgaaatatcaatatataattctaaaatttaaaatgatacaaaaatgtataataaaggaattgtcaccgcttctcaccttttcaatccatttttaaactcttattcttctttccaattctcaccctctccttacagataaccagactccttagtttatctttccagtgtttctttttctcacatatctgcaaatacattatattgtatctccttctctgttacagaaaccttagcatccctttgattccttttgcactttgcatttttcacttaatgttgtagtctggatatcactccaaattacctcttaaagattttctcattttttttttttttacaactgcgtaggactacattttatggaaataggcaagtgtactcaacctctctaatggataagcacttcaattgctttcaagttttagcgattacaaacaatgccttcatggataaccttgtttatatttttgaagttggatcattaaggaaaatgtcgagacattcatttccgagtcaaaggtaaatgcatacatagttttatttatattgtcaaattctcccttataaatgttggaccaatttacattcacaatagcagtgtttgagtgtgctagtttcccttgaactttgccattgaaatgtgttgtcatacttttaaatttttgttaacgtgaaaggtaagaaatatttcagtggctcacgcctgtaatcccagcactttgggaggccaaggctggtggatcacctgaggtcaggagttccagacaagcctggccaacatggtgaaacccagtctgtacaaaaaatacaaaaaaattagccaggcatagtggcgcaagcctgtaatcccagctacttgggaggctgaggcaggacagccacttgaaccctggaggcagaggttgcagtgagccgagattgcaccactgcactccagcctgggtgacaagagagagactccgtctcaaaaaaaagaaaaaaaaaaaaaaagactgggagcagtggctctcgcctgtaatcccagcactgtgggagactgaggcgggcagatcacgaggtcaagagattgagaccaccctggccaatgtggtgaaaccccatgtctaggaaaaatacaaaagttagccaggggttttggtgtgcacctgtagtctcagctactcaggaggctgaggcaggagaatcgcttgaatccgggaggcagagcttgcagtgagccaagattgcgccactgcactccagcctggcgacagagcgagactccgtctaaaaaaaataaagaaagaaataatatctcagtatattttaatttgtatttttataattgcgatgaggttgatctttttttttttgtatttttaaagttcattttttgtctatttttgggggtgattttgtcttttgctcatttttctatcgcgtacttggtcgttattctaaatcccatcactctcaatttttttttctttcatgtttctgctcattcccatggagttaatctgggtatgttctccacttatgcttcgcccaggctaagctgtcagtcagtgcagctcattctgctacccttctgctagccctgtttccttgtcacctaaaatacactttttaagtttttaataatgttgagtcagcattaacagaataaattggccacattgggccaattagtgagaagtctcatttctatttttgtggcattttaatcctttcttattctgtgtttctgtttccttggtgtcaatattcttatatggatatgtgatagtcttccttagtgtctttctactgtccatgccataacaaagttcctttctttgctaaatgtgagatgtgtacaagtaatatcttacatggatactttgcaacaattgcatgctatatgtattttcaccaccccttagttcacagatgaaaaaccacgttacagagagataaataactgaattcatacagcaagtaattgatacaaccaaattttcaaaccaggcaacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagttcatatattaagtaattacaattctgtggtgtcattggtcttgaaaattaatttatatttaatttgttatatcagatattaattatacttggtagaaggacaagaattaatacagaattcattaataaaagagtgtgctggtttattttaaactatccttagattgtatctacgcaatcaagggatatttttggtctatttgatgcgagaattatatgatccaaactgaaatgatcactggggaagtacattttcacctgataacctttatttaactgacacaattatatcaggcatgaactagtacaagtatgcattcacagccacagccatgtgcatactgcataacatctgccagactggaggcaccatgagtcactggagtaaaccaggagcttagctgacattgtcacatggtcattatcctttattattgttaagaattaattttattacaaatgtgaactaaaactaatttgaaataaaacactaataaaatgctaattaaataaaacacatgccagtactagttattaaaattagataaaaataatcagaaaacaaatttttatatcatcaagtattgtttaaatcaagtttactgtgattgaaattaccttacggttatctgtgtgacacagagatgaaggctgatcgtcaaagaaaattctaggaaacatactttttctgacgttgaaaagttgctttctgaggagtctttattcctgcagagaaatcaacacaaccgggaaactcttgtctctcatgcctgctgtttgcttattttacacaagtgacattcatcatggcttagttgatggaaactgagcaatgcttgaagttttaagactacatctgcagagcccaaataagcagaaagccttaaaataatctcatgaactcaatatagtcaggatagaataagccaggaaaatcccaaatccccatttaacttaatcaccctaacagttttaatggcacacttgtaagaaagtaattctttactggtgcccaacaccttctgtatacttcattaagggtaaaatatatggttgagtctttcacatagtccacacttcagatcgcccagaatctcattctgtgctcacatgttttgtgtgaagtttggaatcagtagggttttcctttgaaagaactcactcctccacctgccatctcgctctgtcatcttcaggtgaatgccaaatattggttctgagttaatgctgtgtggtgttgttattctaacatcccaacaggaaagtgccaattaaagggaaaaagtgttgaaaataaagttattttgttaaaagaacatacgtaggaatgcttctctcttaaatatagttatggatcaaaatacagaaattaagtgtttgcataatggaagactagacaatttgaatgaacaaataatgtaactataaatataataataataacacagaattgttattcagtatacttgtattttacatactgccttgtagggttatttccagtgattaacgtatttcacctggcatttgttagcacacaactgactgccaccaccacaggacggagaggggagtcggtgggcattaaccacagtgtaaatcaggttgtggaaatgcagaggcagtcacttgccttggcactcacacatctaatgtctgaagaagccaggacgagttcctatgttgtacattctcagtctagtttttcttactggactcgataaggaagcagaataattagatctatggagatattaagtatgagtcaacacaatgcaaaaactatcaaagtagccaatcactctttgtctttgattgttgccaacatcttttttctccaactcttattttggattcagggagtacctgtgcaggtttgttacctgggtatattgcatgatgctgaggtttggggtaagaatggtcctgtcacccaggtactgaacatagtacctagtagttagtttttcaaaccttacctccctccctcccccatatagtagtcaccagtttctattgttgccatttttaaaatccctgagaatccaatgtttagctccctcttataaatgagaacatgtagtatttggttttctgatcctgcgttaattcacttagggtaattgttgccaacatctttaatcagagatgcaatgtgtagaaatatgttagcaatggaagcatattgaaaatggacattgatactgtgtcattttgttctctcttaatgacaaggacctatctaagagagttaagttctcctttgttccaaaacaacttgtagagttgttgttcctttttttttttttctgattttagaaaaaaatatgtgccattatggaaaacatgaaagtggagaaaaatattaaaagaacaaaaatcacccatagtctcaaaaccccaagtccattccctgaagcatttttattatactttcctccaatatcttgtgtgtgtgtgtgtgtgtgtgttttatgaagtaaaattatgcagtcctgaagggaatataaagcaaaccatttcacttttccaaactaaattattacggaccatttttctattgaacaattacatcactcaatttaaatacaaagtattttacccagctattgtctgaacaaatcaaagctgtctaattacagtattgtatattgtacttttttaaaagcttgatatattcaaagatcaaaagcatgtaacaccacacctgggttgccatagagatgtctacattttatcaagattaaaaaaaacttaacaataaatgcatttttataggtatgctaaagacttaccataacttaaacacccacaaacattttttttttttgcatcaatattctgggaaaaatacaggtgcaagatattatgtgccttttaaatagcttcattttctaaacttacgtctttttttcttctgatgcatcctttccactcacctattttttagtttagaattgtcagtgaaaaagttatgtttttcaaactctggaaatatggcctgccaaactgatagtgtgaagtatggagaaaaataatgtgtatacacacattgcacaacatgtacatgtacatacatgtatatatgcacatatgtaaacacagatatgctatatgtgtatgttatatgcatacaaatgtgttttttatatctgtttctactctatgtatatacttacaaacagagcacaagcatgagattcttaaaatgtacataggacagaataaaggtcatctgatctagataagagtcatcatacatattcatagctctgaaattatctgagagtttggggaggatatttctctagggacctttaaccttaatgtcagggtgttgatttgacaagcatctctaaagaatccatcactttattagaaaaagcaaagtgtaacattattatttttttaacaacccaaactttaaaaacctttggagtaactcttatgagaaatacctgacttttgtaagccatgactacagaatttcatgttggcagtggcagaaaagagagtgcagatggagaggagcctagctttccatctgtcatagcagcatgcagaagatacactgcttattgcttcagctgtttctaaatgctgagatagagtcttgaaaaggaacaaactccaaactcatggttctttaagcagaatttgtcagctggattcaaaagaagcaaaaatgttagcatgatgaaataatatgcaggtagagcctgagaaaacctattaatatcaagtaggaaatagaacagtcagagcatggtatagtcatgttattgaacagagatgtaaaggggagaactataaattcttactgctgaagtactagccctgcaggacatacagactgcatgaagcccaggcttcctgggattttttttttttttttttttttttgagaaggagtcttgctctgtcgcccaggctggagtgcagttgtaggatcttggctcactgcaagttccgcctcccgggttcacgccattctcctgcctcagcctcccgagtagctgggactacaggcgcccgccaccacgcccggctaattttttgtatttttagtagaggcggggtttcaccgtgttagccaggttggtctcgatctcctgacctcgtgatccgcccacctcggcctcccaaagttctgggattacaggcgtgagccactgcgcccggccttttttttttttttttttttttttgagacagagtctcactctgtcacccaggctggagtgcagtagcgcaatcttggctcactgcaacctccgcctcctgggtttaagcaattagaggtgtgtgccaccatgcccagctgatctttgtacttttagtagagacggggtttggccgtgttggcaggctgttcttgaactcctgtcctcaactgatctgcccgccttgacctctcaaaatgctggaatgacaggtgtgagtcatcacgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccccatctccaccctagaccctgtctttccacctcattttcaggattaattagccctcttcctccttaatagtaccctctcagtatagtcatatctcttccctgaactaccatgaaatcttggaaactgtttttctcctaccagtcttgtttctttatcattccccacatttaattctgagtaattaatgagacataagaggactttttgtttttctgattaaaggtctatcccaagtttctcatcatcttgtagtaagttctccatggcttggttctctctacttcagctttagctcctgcaacacttcctgcctctgattcagttgctttccccatgtttaaattcttgtgcacctccctcttgttcttcaacacttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagaataaacagacacagctcagagatgcctagaaagaaagctctgtagaataagtgggactcctgcatggtttccctgagaactggttttgctaagatcatcttttgcccttcagttttattgtacagcaccttcaacattaccttcctgtgattgaccatacatttagaagaatccttcagttgccctgctttaagaacacaatcagttattttagaaaggtaagattgataccaacatgaaaggctgagcagctgtaccgagtgcagagaaataagagtcacctcaggcatcaaactgttcatagtcagatttagaggaaatcaataaataaacttgctcatactttactatatttagttttgattcattggataaaatatatctttaaatatcatcataagaaagtgagtgtttggtaccattttagagtttgaatttgaaaaggatttcaagtgtgaggagtcgttctcctctggagatatttcacaggcaccatcattagtgtcaagtggagcagcctaggggggcccctttacatttattgtctttgttcctaaaagatcaaacgtagtttttccttgtacgtacagaagctaggagcttgccactttctcaggaggtgctagctctggctgaattcaatttgtgttcagaactgcccgaagcagaatttcatacatcaccagctcaggatctcacccttgcaattatccatgttgaaagactgtggcaggcagaataatgatcccccaaaatgtccacaacccccagaacttgtgagtctgccaccttttatggcaaaggggaattgaggctggaagtcagttgagagagcatactggattatccaggtgggcctaatgtaatcatatggacccttaaaggcataagaggaagaagaaaagccattctaagagatgtaataaagctagaggaagtgacgcatgagctcaagaacgtgagcaccctctagaagctgggaaataccttcagtcacagtcagcaacaaaacatagacctcagccctacaactacctgcaaagaactgaattttaccagtaatctgaataaacaaggagatggatttttccttagagcccctagaaggcctcctcactgtcatctttattttattcttctgaaactcatgttggacttgtgacctatgaaactgtaagataatacatttgtattgtttgaagctactgactttgtggtgatttgttactgcagcatggaaaagcaatacaatgagctatcaaaaacattgatcaccttatccttgatagggccaggaatgccttaaagaatatcacaatctaattgccaagaaaagataaaaataaatggaaatttcaacaatgataaaggaacaagacagtattttgagacggtaattggttgaatggtgtatagcagtgcatgataaattggcaaataaattctgctaagttttcagcaaagtcttaatgaaaagtcagaaataaatgagtctcaggttcctaatctcaagaatattttagacgctaagcacagagttgctagatagtcttatgaaaattgcttcatttaagagaaaatggcatatcattaagttgaatatttcatgatattgaaatgtagggactccagttgaatttgtcaggaaaatgggaagaaggagactgcatgagaaccaaacttaaatgtacagattggaggatttgaaaacggttgagatggagaggctttccagaagagaacaaattgatgagcatttcagagttgacaatgtctacattacctcctgagacatcaaggtcaatgcacatgtgccgaaagccactcacaaaattgaagtccatcctccaactccaggcccacacttactcacaagcataacttcctcacctcaacagtgggcagtacataatttctgaaaatgagacaatacagagtaatctctcatgcatctttctttgatgtaacagagaccagcctgagttgtaataaatttagggaaagcattcactattattttggtttctaactcttctcaatctgggacaaaatgaatgccactgaaaggcaagaaaaatactcagataatctctcttttccagccaaatatgggagtattgaaggaacaaggagatgacagataaagatgcttttagagcagctcctaatgctctctctctctgttcctaaatgaatatggccaaggctgaggaggtttctacttatgagaaattgtccctgaaagtactccagctgctcactgactcccaggcctaaggatagtcagtctagaggaagatgctgcgtctaatatctcttcctgcctagggttccgtagagtctagtttctgtggaaagccatgtatggcgataaaatgagtgtgatcctcttagcaagaaggcatgggtggaatttctgccttccgtgtttgctaataaggggacttcatgccaattacctaacctctctgggttttagttttttcatttgtcgatggcactgatgatattaatggagcctctctcagagtaagcacttatggatttttgtatgatttttaatgcgatgagataaatcttcagtaaaatttgaagtattataaaatgttagtattcttgtagttattattgcattaattttctagggcttctataataaagtactgtcgattgggtggcttaaacagcaaaagcttatttcctgtggttctggaagctggaagtttaaggtcaaggtgcccacagggttggtgtcttttcaaggtgcccacaggattggtgtcttttgaggcctttctctcgggcttgtagatggccattttctccttatatgctcacatggtgttccctttttgcaggtatgtgtccaatatttctcatatgagaactccagtcacattagattagggctcaccctaatgatttcattttaacttacttttctctttaaagaccctgtatctaaatgcagtcacattctgaaaaactggctgttaggacttcagcatacataattctagggggacacaattcagctcataacattattacaattattaattccagttcagtggttaaaataatatttttgcattatgacagtcataactttatctattaaaaaactgaatacctatttcacgttcctttgaggctttataatcacaaagtcaccacttctcagaaacaaaagcaagctggcagccttgctccactgtctctcctttgctcaaatggccactgaaaccagtgccttggcctctgtgggctttatcacctttgacatgaaatactctcttcacagtataatctcattttttgtgcaccataagggaatccatttgaaatgtagaagttgactccaatgacaaaatacatatgaaaaatagtaactttctgtagtaactctaaatttccttctgggaaaacacacaaacgtacacgtgtacacatacacacacacaaccccccacccctccaactgctaaaattttcatgcctaattgatattttccagaaaaccatttaagctgctttcttctattatggcttctctcctaccaggcacagaaactgtactgaatattagggataagtttcagtagccccatttgcattcagtcctcagacaagcgaagacatggacagtgagtaacatttatcctggggaaactgatcaagaaagagaagccacctggataaaacaagtcaaggaaatttgcatactcagaaccatgatttgagatgctaatcattacagaagcatgttttattggtccatttaatttgatttggagagaaatctccctaaaggatttggggattttgcagacctaaggcactgacatacagagtaaagttggattttactatattacttgtccctatggaatcagttcatcaaggctgctaataactaaagcagtggctttcaaacttgaatggctttaagaattatctggagagcttgttaaaatgccacaggctcaaggaattctaactcattcagtcctgagtgggatctggaaacctacacaatatcaagcccgcttcctcaccccaagtgattttaatttttctaaccaacactcacatagtgtttattatatgtcagacactgttataagcattttataaatgttaacttatttcaagtcacacaatttttacattttttttcccattttttacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagcaaataaaaataataaatgaaaaagttggttagagtgtaatatatccacttgtcacaatcattttagcagctttagaaatgctattactgaaattatttatctggaatcagttatttcatcatatcatttaatttccaattgatcattataatcaacattattatcataactgtttttattgagcacttgttatgggcaaaaggctttttgcattatcttattaatccacccaatattataatattataataatcctctctgtctctgtgacagtaattcttcctatcttcctcttcacatgtgctcctgcaggcacgctggcttccctgtggatctatgaacattccaggcacatttcggtctcatggcctttgcatctgctgttctatctactggaatattattaatcatgatattaataaatgaattcttgcattttcttcaatgattcactcaaatatcaacactttagtgaatccttccttttccatatcatttaaaatttcaacacttccctaatattttctttcccccttcattgttgcctcattcccatcttacatatgtcaattacattttttttcccttaaacattagtttcaagaggccaagatatttttctattgggtgtattcctgtttagcaacccagagaagtgtgtcagccatactgaggcctcctttaaatatttgttgaataaacacccattgttaaggtacggaaaatgaggcctagagaggttagatcacttagccaaagacaagtttcgggaaagtgtcaaagcaaatatggtatcaggaaattgcctgtagggcctaaattctccgtacgtctagtcagctgggagaaacctgaggaacataattgagtttcgtcttttagagttttacattctagagcttctatgctcttggtggagaagctgatgcacacacttaatggctctgatttttgttgtcacttgtgcccagcttaactatggaaaagaatttgatttcataagaataagtgctcttagtagtagtactagagacacacctcccatttgcaaatatacttgctattttcctagtatttttacatacattgtttcattttacttcataatgggacagtaaatccaggttcattatcacctttgtgtggatgaggaattggaagcccttttgggttagtgattttctcgaggtcatacagcaaaaatgtggttgtatcagaactagggccaaggttcccaatctctgacctgatttttcaccaacaattttcttgctcagccgctcatgctactatactctgttatacaaaataactcttctaaataaataaaccaatgctggccctataaaattataggtatggtaagaacagtagtctcagtggtatctgcaaattcctgtattacttcattaattttactcagcagtaccaaagggttttaggaagttgagcaagaagaccccctggtcatttggggacagacatttaacaataaattgagcctgaatcttatagtccccaaacctgacttcctgagtgaccaagcagagatggaatttaaggaacaagcatcttccctgtaagtcccatcattgtgttcaccacaaattacaaatacttatatatgaaatatgcatctagaggcgttaccagtggcaactccatatgggtctgggtctgtagcaactctattcttgccttctttgaggaaagaatttggctgagggacagaaggcagagtgagagactgaggcaagttttagagcaggagtgtaagtttattaaaaagttttagagcaggagcaaaaggaagtaaataaagtacacttggaagaggggcaagcgggtgccttgcgagatccaagtgccccatctgacccttgacttgggtctttaatatattggtatgttccaaggtttgggtttcttctcccctgatttttccttgtggcaggctgtccgcacgcacagtggcctgccagcgtgtcggaggtgctgcatgctcagtgtgtttactgaagttgtgcccatgatcacttggcatttttcccttaccagtcgagtgctgcaagaagaaggtcataaaccagttaaactctgccattttgcctgttactgcacatgcttgagctccacttacccagctcctgcgatctcatcaggaagctgctcatcaccagcttcaggtgtttcccatctattgggagactgcctttccctggcaccagctgcaaccaattattattttagagcaagtttgacatctgcccaaccgtctgctaatggtcacctgacatttctgggagtgatgctctcttgccctgctcatgtatgcctagatacctactctaacagaggtattcagttccgtaaaataatagatttgttgtcattgtcagtagccatcagttatgttttatatttccaagcagtttttaacttcatcacatctcttaagagcaacagccgtatgtaacttttattattaataacccagtgatgttagtataagtaataatctccttaattaccacattccaaaaaaatgtctcggggttgttaatggcttatctaacatctcacagttaatatcacttattctcttgaatgcaagtctgtgcttttgtcaccacattgcagtggggcaggagaaatatctggcatctactaggaacttagttgacatcagctttctctttctaattctctcttccctataattaaattatcttatcatcttgcaactttgtgagatgattgcgtattttaatctccgttttgatgaataagaaagcctttgtaatggatctcaagaagaggaatttaaatccaacaaacaaagagaaaatagtgcactgaatatttgcattgggttttatatgttccaggtcacatttcaaagttgcctttctgttagacttcatagttgtcagggctactaggaaacaagttccttgacggctcttttagaattatttgcactcagaattctttggttctattccagttatttactgttgcacaacaaatctatgtctaaggttagtagcataaaaccacaggattgcattctatatcatagttttcttgggttagaaatttgaataaggagattattgtcttccactggatattaacggagattgcttgatagtgttcagttgcaaacgtgctggtctggaaagcccaagaaggcctcttggtgccttggaaaggataggaccctcgagtagatggtgcctggatgagatggctgggagcctgggttcaccggggactgttgaccaaatgacacatgtggcctttgtgatatgatgatttcaaagtggttggatttcttacatggtatctcagggctcccatagagcgttttccaagagacaggaaacaggtagtgtagcaaaattagtaacaccacttccactatattctactgatcaaatagtcacatgcctgttcagattcagaggaaagaaggaaagaggtatagacacaacctctcagggagaaaaacatcaccaaatttgtggccatctttaatattcacatttcatgtagttctactctatgaggataagcatgctggtatctgatctggtcacagtctgaactgtacagcaaaggatgagggtagtgaaatgtggagtgatgagcattagaagatgctttttgcctctgaggaggatttccctaggcaaaaagtggaaagtagttaaaattgatctttgctgttctgtttgctattaatcttgaggtgaaggttctggcaaacatgttgaataactgaattctgctctagcaaacaacgcccgccatccccatatctactaagtttcctaagaccatgtttcccaaactgctgcaattctgtatcatgttgaccatttttaccatatcagggtccttcttgaagtattgtttaacttctttttctaacttaatttactccattttatttaagttttaagatacatttttcatcactcttataaatggaaagccattatcacttgtcataagtagagatacttctgaaaataaaaccattatctacagcagaggtgagcaaacgtagtggtcattggctaaatccagactttggcttgtttttgcacaatctgcaagcaataaaataaagaagggagggatggattatggacaagaaggagagaaacacagagggagaaaggaaagaggaggaaaggaagttgggaagaagggaaaaatggaggaagaaagaaagaagaatgtagcaaagaccatacatggcctgcgaaagctaaaatatttactgtctgtctcttcacagaaaaagtttgatgaccctttctctagagctatgcttttcttcttgcttgtccttccaatgcaatattatgtgcttgtgtttgctgcctgcttagaaagctgcatttgatgctgtgtggtgaccaacaaatcaatcatgcctcctttccatggtctagagttgttgctgagcagcagctgtccaggcgagggattacaattctgagccatggcatctagtggagccatgagaatggttcttactaatggtacataaacaaaagtgatgggtgtcattttgggttccaggtggttaaatactggttgcatgatccttcacaatctctgtcctctcatgcctttgtctgccagttgaaagatgctttgtttaaggaaataagatattttgcaatttacactatgggatctgatgaacagttgtcagccttaaaaacacatacccattaatttttattgtgtcccattggccataattataccaaaaatacatatgctggcgaagttatagtagcaataaccttattacagggtaactattatgtgggcctgtatgtgacagaaattggtagttaagaaataatactgattttcaggctatgagggcaaaatattgcttgtcaaattcattcagggatattttctgagtcccaaaagtagatgtgagctaagaagtaaattaatcagtttaggatttctattaactgaaattccaaaggtcttaatattaacaaattacaatgattaactcagacataatttcagttgcaggcatgggtaatccagataatggcatgttgaagacatataatagaataaaacccatgcagtactaaaaaataaataaatacataaaagtaggttttatttagtcaatttatcaaggttactatttgttgttgctaattgcagtacttttcatgtgcaaaacactgcagtttcttaaatgtgatgtcaattagcctcacattgaataaaaaaggtaaataagttttatcaagttttcttcctcctctttcccttccttcctttcttttttcctttttcctcaaagaaacaaagataccatacagtcaagtagcttgtccacagttatgtgagcttttctataatccattggtatcttccctaccatttccattttctcctcaagcagtaagccctttaattcatttttagtttatatttctagtttagtgattttttttaacataagcaaatacatatgtggacatctatctatctatccacgtcgccacttcctcacacaaaaggcagcaccctatacatagttctacactggtttttttgcttattttctatttaacgtatatcctggaaattgccatagcaatgtataaagatacctttaagctttcttacaatcacataataatccaatgtgaggatataatatagtttatgtaacttgtcctttttgatatgtatttggaggtgtttctagtcatttgttcttaaaaataatatcaaaggccaggtgtggtggctcacgcctgtaatcccagcactttgggaggccgaggcaggtggatcacctgaggtcaggagttcaagaccagcctgatcaacatggcgaaaccccgtctctactaaaaaaaatacaaaaattagtggagtatggtattgcatgcctgtaatcccaactactaggaggggctgaggcaggagaattgtttgaactcaggaggtggaggttgcaatgagctgagatcgtgccattgcactccagcctgggcaacagagcgagactctatctcgataataataatgataatatcaaaaaactgagaaaatatgacagcaaatgttcttagaaaaacttagaatgtatgataaaataccattgtcatacattctctcatatttggctacatactttggaaaagattctgagatgtaggattactgggtcaaaaagcaaatgcatgtacaattttgttgaaaaaatgccttattacactctctatgatgtttcttctgtatttcattcccaacagtaatggaagaaaatgcctgttttcccacaggctcaccttctttcccaagacaggattttggctgttttcttctgggaataaaatacttctcagtgtgatgctttttgttttgtttttgtttttgttttttttccattttacttgtttgccaatcctattatttatgcaaaaactacacaactttttttaagtttatattcccactaatcatagtagcattatattcttacttgagttttcattgcactgttctcataaggaacttgagtatcttttcatatgtttaaaacttttttcattttttattttaaaatttttgactgacaaattaaaactgcatgtattctaagtatatatgtgatgatttgatatacatatgtaatgtgcagtgattagcacaatcaaattcacacattcactagcagccatgctgcacattagacctccaggacttgttttataactgaaagtttataacctttgaccaacattgtccttttttcttttcttttttttctctttctttttttttttttttttttttcttttgagacggattctcactaagtcgctcaggctggagtccagtggcacgatcttggctcactgcaagctccgcctcccgggttcacgccattctcctgcctcagcttcccgagtagctgggacaacaggctcccgcgaccacgcccagctaatttttttgtatgtttagtagagactgggtttcaccacgttagccagggtggtctcgatctcctgacctcatgatccgcccgcctcggcctcccaaagtgaacattgtcctttttcctactccttagcctctggtaaacaccattctactctctgcttctatgaatttgaacttttaagattccacatgtaagtgagattatacagtatttgtctttttgtgtcaggcttatttcatttaacgtaatatcctccagttcatcaatgttgtcaaaataaaatcggtatcttgaagatacacttcgtgcacccccatgttctttgcaatctcatatttattgcagcattgttaataatagccaagatatagaaacaagattagtgtccactgatggatgaatagctaaacaaaatgtagtctatgtatatacaatggaaaattattcagccatagaaaagaatgaaatcctgccacttgtgacatatttgaagacattttaatgtctttccataaagtgtttgatcacatgttgtgtccatttttctttcagcttgctagttttattcttcaacattctttgaagctttaaatattaggcatactaagtttttatcagtgatagaatttacagtatctgagatataatttacaattaatctaagatccaagtaacaattattacaattattactctaagatccaaaacacaaatatttattgtagttggtcatattttgcttaggtatttttggcatgtaaactattatactttttaaaaacttatgtaaaaaatctattgaccttttccataatgcttttggaaaaggaatatatcatctctaggtaggtgtataaagaaaataaactgttctctttaatacttgaataatttctgcttatttgcatctcttacccattgggtatttgttgtggtatctgtgtgtaagaaatatttacaggctttttaaaacttttatgtttggtgatctagttcctcatatgccatgtatttaaaagttaatcttttcattaatgacttggaaaagcatattttcatttattcatatagcatatctttccttttagtgtttctctcagtttcaaaaatcattcagtctattcattaaccaatatttatttaataaaatttgtaatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatggaatcatgtgttgcacacacaggaaacaaagggtgtttttaaatgtcagtcccacatcaaaagatgcaaaggcaaatgcttttagtagcagaatttgatttgtaattgagctttttctcccaaacacaattctttttgtttggggtggggaatgaatttcagcaactccatatatgtttgttgaacaaatgaatgaattaaagaatgaactccatgaactaaaggcaggaatttccatgctcaagtttgtaaaatattcttctatacaattatagttagggcaaataacaatacaaaaatatattcaggtatgcctagaccataagaatggctcagactggattgtactggaaaaatgtatggatctgattattgaataaaataaattattacttgtaaaacgaaaaattggaaaagagccttagcagttgaatataaaatattaaagagtattaaaaatgacataggcattcattcacttgaccagtgttcgttttatgcctactacatagctagcaaaaatctatgatgaattactaaagtgaacagtgtttgtacacttaagataaagcatttagtaaccacgaaactcctgcttgaagtccttaaaaccatgaaatgtcaaaccaaacccagattctcagttgacagattgttgtattaatccattcaccaaaatgcaaatattaatagagaatgcatttttattttatcaatacatgctttaatgttgtctgaaatgtttggggaataaagaagagaagtaatggctttaaaagagttaagttcatgtttacccaggtggacaatcacagtctaaatgctgattaaaattttaggtcaacttggagggaaagaacctgagatcactcacagaattctgctcaagtgccttcctactttccgtcaataacgtcaattgatgtagagaggattttttacaaatataacttatgaacaatttaaatctggaagagcaagcaattatggtgaattctagaatcaatgctcagaatcaaaaggctgaaatgacacatcaaagctagcaaaatgaaatcaactggaatctaacaggttgacattccatgttttaaaaacataattataaaggtaattgtgcaagaagtcatggaataccaaagctcagaaacaaaagtttaaacaaaactttaacttgagttgacattaaaatttaaagtataagtaatatcctaagactggcattcataattgtgcagatattttccagtattacaatggatagtttctgccaaataactcatctaacagacagtcatgcatatcggtatctatactttcagatacacattttttcagcaaaccaggtactgtaaagtataaggccctataatgttcttttcattatctaaccctctaacactttgaagcacattaattctttttatctccctgctttttgtttccctctcattctgacttacattggttagccaaaggagcagcagagtattgcagtctgagattaaagtgaacctgctttccttttcttttttttttttcccccatatggtatttgttttctttattattattattattattattattattattatactttaagttctagggtacatgtgcacaacgtgcaggttagttacatatgtatacatgtgccatgttggtgtgccgcacctgttacctcgtcatttacattaggtatatctcctaatgctatccctcccccttacccccacctcacgacaggctccagtgtttgatgttccccaccctgtgtccaagtgttctcattgttcaagtcccacctatgagtgagaacatgcggtgtttggttttctgtccttgcgatagtttgctgagaatgatggtttccagcttcatccatgtccctacaaaggacatgaactcatccttttttatagctgcgtagtattccatggtgtatatgtgccacattttcttaatccagtctatcattgatggacatttgggttggttccaagtctttgctattgcaaatagtgccacaataaacatacgtgtgaatgtgtctttatagcagcatgatttacagtcctttgggtatatacccagtaatgggatggttgggtcaaatggtatttctagttctagatccttgaggaatcgccacactgtcttccgcaatggttgaattagtttaaagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagtattgtttcatgtgtctgttggctgcataaatgtcttcttttgagaattgtctgttcatatcctttgcccacttcttgatggggttgattttttcttgtttaagttctttgtagattctggatattagccctttgtcagatgggtggattgtaaaaattttctcccattctgtaggttgcctgttcactctgatggtagtttcttttgctgtgcaaaagctctttagtttaattagatcccatttgtcaattctggcttttgttgtcattgcttttggtgttttagtcatgaagtccttgcctatgcctatgtcctgaatggtactgcctaggttttcttctagagtttttatggttttaggtctaacatataagtgtttaatccatcttgaattaatttttgtaaggtgtaagggagggatccagtttcagctgtctacatatggctagccagttttcccagcaccatttattaaatagggaattctttcctcatttcttgtttttgtcaggtttttcaaagatcagatggttgtagatgtgtggtattatttctgcagactctgttctgttgcattggtctatatctctgttttggtaccagtaccgtgctgttttggttactgtagccttgtagtatagtttgaagtcaggtagtgtgatgcctccagctttgttcttttggcttaggattgtcttggcaatgtggactcttttttggttccatatgaactttaaagtagttttttccaattctgtgaagaaagtcattggtagcttgatggggatggcattgaatctataaattatcttgggcagtatggccattttcacgatattaattcttcctatccatgagcatagaacattcttccatttgtttgtgttctgttttattttgttgagcagtggtttgtagttctccttgaagaggtccttcacatcccttgtaagttggattcctatcctatcctattttattctctttgaagcaattgtgaatgggagttcactcatgatttggctctctgtttgtctgttattgctttccttttcattcctgacaggcaaggtgagcgccctgaacaacacagctcccctgatcttttccccctacctactaaagggggttgtcctcctaaaggggcactgaaaaatcactgacatgaggcagattgattgataggagaaaagatgtacaaatttatttaatgtgtacacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgctaaaaaaaaacaaaaaaaacaaaaaaaaaaacaaaaattagctgggcgtggtggcttgtgcctgtagtcccagctactagcgaggctgaggccagagaatcgcttgaacccaggaggcagaggttgcagtgagtcgagattgtgccactgcactccagcctggtgacagagtgacactcggtctcaaaaacaaaaaaagaaagaaagaaaaaagaaagaaaggaaaaaaactgaaaagtcctgggtatattaatggaaattctctacagaggcaaaatttttccccaaaaaagatacctttgcaaggccacttctgtttgctggcactgcagcaggcattttataatatgtgaaataaatatatttttggataaaatatatttatgtcttttggtacctactttgaaacttaaaacaatttttacacattaaaagccaagctgattgctttggtagaatttgtgttaagggtcgttagttagagatagccaaaaaagtagaaagataaattggtatatacagaaaagaacaaatttaaacatattgtttaaatcttctttagtctgttagtcatgaaaatatatcagttcagttaaacaattgtgtctcattccaagaggtggcattgcagatgggctttgcctttacgtgtgatgcaggcaaccagctctctaataaagcatttctatggaaacagaaggaaaacaaaggttgatgcatggcacggtgcctctatagactagcttttctagagtttctagggcatcctcagattgcaagggcaacctgacagattcttctggattgtaatttggaccaagagttcaagtgaactttctgagaaatccacacatcagcagggaggcatgaaggttgttcatatataagttgctattatttttttactgacgtttaagttgtctagcttcaatttgcagggctttaagaaaagcacagttttaatttctaataattccaagccagaaaaatggaagaaaaaatgggaaataaaaaaatgttagtttggagacttgtaacaagtaaagaattcagaattcagactaaaatgtagagaaaaaatgaaaactcaaaactaatggacaaggctagaatctaataataggtatatgactgtctcttttgaaacataatttttctctctctattcccccattttttaccaaagacaaatcatagcaggaccaatttatttgcaacacaagttttagtcttattatacttggcttgattaattgcttaaagttcaacaggaatcattgttcatataggcttttagacgttggctttgctggaacttttttcataaggaatctcagattggacttttaaaaacctttcaagcccagccaataacttacctctgcctgcagatacctattatgaagtgggtaaattcctctcttcttgaagtcctcaaaaaacttgagattcttaggcctgtcagaaagtggcattctttacttaccataggtcaggaaccctgcaaagtaaccatgtagacaagagaccagtcattccaaggggctattattggctctataaaatcaatcttaattcctcaaagcattctggtcatatctaaaggtatgcccttccagctgaagccatgctaaattaaccactatctctatttatgtcctgttaaaaatgaaacagattcttactcaacttacacaaataactatattgccatgaattaagaatacttacaaataatttccaaattctggagaaatcagacagaaagaaatatgcttctaagtttgtttacaagagtatatttactcagttgttaaaagctataaatagctcaaaagaaaaaagttttcttgactctgaaaaacaaaacataaagaatcagcaatgttttaaacaaaaaaagtcataaaaaattatttcagtatctaatagtccagtcccatgcaattaactcctgttcttcccgatattacactaacaatcctcattaacactttagctctccagtgaaagttctggaagttttttctctagtccaatggcacaatctccaaaattaacagaaacctgctttcaagcatgcctatccaggtcctttctatgaactccccataagaagcaagttttgtactctagctgatgataaaccactttttgaggagaatcaaagcaaaacaactgtggatgacaaaagtcttagcacagccatggtgaaagacacaattgacaaggaaatttggttacttctgtggcatacaaaaatttatcataatagatataattattactgacaacatactgagacatatcagaattatagaaatcccatactattttggaacacacactaataacacatttatataaatataacccaaataaagttaaacattattttatatttcacaatgctttctatatgattttaacataccaaataagctgaatatgtctttcaggggacctaatatctaaaaagctaatgaggtcaaaaagacagaatttgaaatttgattttggaaagtttgtcaaatatgtaagattttaaacatctgatgtcaaaaattaggcaaatattttagaaagcaaaaacatttatgctttgagaggagactcagtttcttaaacaataaggcataataaagatacgaagacaactgaatctgtctttctcttccctttttttgcagtttactcaacaggttaaaaaaaatctgttactatctcttactattaactgaaaactttatccaaaagagaaaacaaaattttacttttcaatagcatattattaatgctaaagcttatttcaatgaaatcttatgaacaaactcatccaatctcaaacagtttgaccataaagtaagatttttatagacccttttataaaccttaataattttctattaaagagcagatcaatgttccaagaaaaccattactgcaacacaaaggccctgattctggccctgtgtcagtgtgcttttgatattaatgtttaatttatagaaaaaatgaaataattccctttaaattttagccaacttgatcacaaacaaaattccttttttaacattaatctgccataaaccttctataacttacttaaaccttcagtttttttctaatattttactttaggacaaatatttcctttcctccccaattttctatatccgtttagttttatccatcatttttttctttaatttaaaacaattcttataaacctttaaatgagtcagaattactttttctttaacaaaaaccacatttccatgttttttataacctttttacacgtcctactttattatatgctttgtatatagaattgtttcttttatatctagtagttttaattttatttattacagtgttgactgtaactcttgtttttagtggaaaacctaggaggtaagcaattttaattatgtattagattcagagcccagaacaaaggacagagctgcagataatgccttaccctttcctgcatagccaggaggcatagctaggccaagaagaactcatgtctatttgtttagagcctagaatctaatagttgtaaaacaggcaagtcaaatatttgtcaaaaatatcacacataaatatcacaatttatgaccttaaaacacctagcaaaggcagtatctgacctgcctgtgtaattcagactgaatttctaaattaaagtctgaagatgtttccattttatcttaccagtaactttcaaaaactcttaatttaccaaagattagtcacatgaactatgaaactatgtgaggtaaaatttttatttttctgtttaaatatttgatttaagtattttttttccttaagacaagtaattagagctcttttacatattttagtaatgaaacatcatatgtgcttataaatgtgtataaacacacagacatacaggcagagaaacaaatcttcacttgtcatatttcaaagtttctctccagtattttagactatcagtctcttgattacctgttttcttctctaagcaattattagctaggcaaccccaaatgtgcaattctaaagggacagctcttgtaaaacaaagtagaaaatttatatcttagagtacaaaggtaaaacatttggcctaaatattgtatcatcatctgctcaaaccacgggaaaaaattatgtgagtaaaattcagttaagatgaccagagaaagcaccttaaacaaagagatgacttgtaaattttaaacaatggtaaacacttttaatgtacacaggtaggcaccctttcaaatggagatttccttaaatatgtaaatttcttttacaaaagagtgtcaggatagctagctaaatgctagaaagttgtattttggctattttacttaactcgtttcataattagatgactagcttcagagtggagccccttggtgaatatgggaagaaaagcatacagtttttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatccaaaaagagaaaaaacataaaggtcatatatacatatatatacacacacatttatatacattatatattaatatatattttatatgcattatatatatttcatttacatatataaataaaatgtgtgtgtgtagcttagatatcagcttttaattaagcagatttctaactgtagtgctcactcctcaaaaataaaaaaactttcaaaatcttattactggatttcagctgggacaaatagcttgtcttggcttttgaactcctttaccaaaggtctaaagcagtcctcataagatctagaaatatcaaatcaaaagagactaagtgattccttcatcagaccaactcttctgtcaatggttgagagaaagtgttactctcaaactatgattgtaaagttgtctatttctcccttgaaatctttcagatttttgaaaattctaaacttcagttattaggtatataaacatgtatgattgttgtgacttcctctcccttttatcattatgaaatatgtctctatgtttggtaatactaattattttgaagtctattttatttgatattattattgctacttcagccttctgacacttgtagatctttttccatccttttactctcaatttctctgtgtctttgtatttaaatctttcccttttggatagcatatattggggtcttatgggccttttttttaatatttgaacataatctttgccttttaacttgagtgcttagcccataaacatttactataagatacattcagatttagttctactattttattactggtttctatgatggtcatcttttattttctggtccttatgttggccatctttcattttttggtcctctgatctcccttccctgccttcttcttaattacttgaatatatttttagaattcaattatttctttactagctttttacctatacctctttgtatcattgttaagtggctgttctatggcttacaatttatatcctttataatgaacaatatataacagtatacttcaatttttgtagcattttgtgtaaaatatagaaaacttgcaatcatataacaggtcactatcctgtaattacagttgccatctgaattaatatacacacagattaaaaatccataaataattttataatatttgctttaaagggtaaattatattttgaagaaatttttaaaatagggcttttttatatttactcataatttaacatttttaatgcggtttgtttatgatgaaagattcaagcttttcatctggtataatttcctagtttctcttcagcctgaagagcttttttttttttcattaataacatgttttttggagtgtaggtttgacagaaataaatttccttagtttttcatttaaatatgtatttattcgatattaatttttgaaacacgtctcactcattttaaattatgagatgagaactttatttatttattttttacctctgtaaaggtttctttttcttccctgctctcttttgttcttcatgggtttctgatgggaagtctgtttttattccaattattacacctctaaaatcatatgttattttcactgagtagtttaaaattttctcatgcttttgactttgaacattttgagtatgattatctacaaaatatattctgaatttgtcttatttggcatttgctcaactattaaatttaacatcttgttcatttaccaaaaatggtagttatagtcattatttcttcaagcagctcttctgctccattttctttctctccccttctgggactcaattacctatatgttaaaacttttgacattgtctcatagacttcttaggccctgttaggttggttagaatttttaaaatctctctcatcttttggtttagtgaaatttattgacagattttcaagttcactggccattttctctttcatctcctttctcttattaagcttactcagtgattttatttcagatgtttatttatttcagttctaacatttcactttcttttttatattgtctgtatctttgctaagattttatactctaccttgaagaacaaagttataagaggtgctttactagcctcatacgataattctagcctctgcaccatcctgattggcatctgttcattattaatacctcgatattgggtcacatttgcagcctttctatattgagtaattttgaattgcatcctggatatcgtgagtgttagttatgctgaatatattctggattctgttctattttacctccaacagattattgaaggtgtttattttggcaggcaatttacttactgtcacacatatagtgcattgtagctcacatctcacttttttttgtaatttttagttgtaagttgctttaattttgcccaccatcctccattcaccttatgaatggtcccagtggtcaaccaggaacttaccttgagtttatgcactgaattaagggttcctttttcctggtctctcctttctgtctttgactctttgggagccattgttaccccagagcgccgtcacctgttttttttgtttgtttgtttgtttttgtttttttgatgagaagtcatttttaacctatctccactgcagcagcagctatcttaaggataaatcaccaataaaatagggattttacgctatgctgccccaagttttgattcccctttagaaactccctgcttgcttcatcctccaaagccctcagctagttgtgtttttgattttatccagcatttagttatttgtgtaaggattgtttttttaagagcttactcttcaatttcaaacacccaaacttcctgttcaataatttttgaaaacctaagatgataatgtaataactttctctcagatgaataagtattttaatagattttctaaaatccagtaaaacatactttggaaaaggacaataaaagtttttcttaaaatttttatttacatatcaacttaattaaacgtgttagctgatttccatgtatatatggaagatcagagaactaaattcttcaggtaatctatttttgcacatctttgggaaaaagatttctgtttgattgcctctaaagcgtagctcattcacatttaattatcttaagaataggccacttgtaacattaatccacaaagctgaatttataatttgtaagagatggcacctttgaagttgacatttcttttatatcaatgagattgcagctgcagatgaagtgcaaatggcaaattatgcaaaataaaataatcacgaggggaaacttcagttgaatatttctgtttgattaataatctatcagcagataccatctaatttaaatttgcacaaaagcataactgctgttgaaaaattgctgctgtttaacggggacacaaattcacatttctttccctcctcctctttgtgtagccaacgattgcagttacttggttttgaattgggctttttagagttaatgccttgaaaatagaaaaataataaaaagctttccttcatcctatttatgcctattcacctgcttatcatcttcaagtcttttctaggtcctatgagactagaatcattattcagttttgcccagttacctacttcttaaaagagaaatgtcattcagattctttaaactatagcggatagtcattgttctggtttgtcaaagaccaccttaaagtggtgactagaattgaaaagagaatttatttaagtaagcgtgatgaatctaacttttctcattatctggactataaaatgtcattaaggtttcctaagattcaattaggtttctttgttttttaaggggttggtttctttatgcgttttgtttctgtagcaaccctatcactcttgtaacagcacaacacaaacaccagttacccaaatataaaaacataattaaaagctatgcctttttcacatcagataatgccaagtctgggatatattacctgattctgtaacgtagataaataccttaaatgcattgttattaaaattgaccacagtgataaaatttgaccacttgacagaaattctaccctattaaagactaatctttagagagaaaagaaaaaaaatattacttgggttaatgagcttggatgtggatttagaaggtctaattcccaactagttgaataacaataattgtatcactttctttttttaaatggagacggagtctttctctgttgccggctggagtgcagtggcacgacctcagctcactgcaatctccgcctcccgggttcaagcgattcccctgcctcagcctcccaggtagctggtattgcaggtacgcacaaccatgcctggctattttttttttttttttgtactttaatagagacggggtttcaccatattagccaagatggtctcaatcttctgaccttgtgatccgcctgccttggcctcccaaagtgctgggattacaggtgtgagccaccgcgcccggccaattgtgtaactttcaacaactcatttgacctctaaaatttctgtttctttaattgtaaaactagatttttaaattaaatcacctgtatcttctcttttattctaaaaatggacattttcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctcgaacacatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgaggaaaaaaatacacctgtttgcaaggtgacatttctttgagggctcactcatggcacagcctggggatacacagaccacgggccaacatctgtggggaactcagagctttgctaattgcattcatcatattttctggggattcacttagtgctctgaaaaagccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaaggatctgtgaattgtgacttggaacaggtgggcgcacacccaccccccgccccgccacccccccaaaaagaaacaaaacccaactctagtcttcatgacagtggcagtgaccaggaaaataggacagatctgttttctcagctttctctgcactccccagtgtctagagaggaaggtaagcaagggtgtaagctcaggccctggtgtaacgtttgggcataacagagctgggctggaacttggcctctccactactgtgtgttttcgttgttgttgtttttttttgttttttttttttttggatttcttgacagctctaaccacgtaaacctaatagcagagaaaaggagtaagtgtcagccctgccatgtacaacgctgacatattttaaaagcaaacctttgttcaaaataaatcttaaccattttagagcactgctatttcttcactggaatttggatcagagaacaaatccagtccactgacaagatgtgagagaaacacaagagtttctttattctgtaagataaaatatttatgagatgatttttatcagaaggcacttattatgtagcaatctttacagactctatgcttgctgcagagttatctatgcaaaatttaaactaaaggaaacctaggtgtttacatcttaagaaagacatacatttcaaccaacagaacatgtgttatagagttgtgttttataaaggtagagtggtaaacataccttaggctaaaggaagaaaaatgatagggatatgctgcaagctgaataaacctcccttctagctgtttttttttttttttttttttttttttaagatggtagcttttgagacagtgctatctttcaggatattcagattccctttcaaacaaatgaatattctgtgccctgattgcatgttttgttaagttgggtgatgacagtggattcttagggttgtcctcctgagagagtagccccaactctattttcggagtttttctattctctagtctttgtatatgccacagacatttggtctctgagtcctcagtcttataacaatagatcttaagctttgttatctaaaaaactatccagcttctgatttaaaaccaagctgcctaactgtaattctcatatctgttatttcttctaagatctcagaggaatgctctcaacctggactattttagctcattcaatagaacataacagcagtctctgagcctgagctggttagccaccatagttctgttctgtcagggtaattgctatcatgattcacaactagtgtctcttttcttcaagaaactgtcactcagatttaccctaccttcttcacctaaatccaattctttagatcataacctaaatctaagcctttttcatttcacaaccctacatctgcaaggttcttttaattattctctgactgtctttcagttttctaacatcgacagtatagccttgcatacttttcatgaggtcatttgctttttgaaaacataagtagccacctccttcttaccatactgcaaaaactcctgtgtaagactgtttaggtcatttaaagtctgcacatctccaatttcttctcttgtacttaccacaagaatttaagaaaacattaattaccgaatgatttatgatattttcagttgcattttactctaatttgatatatctttataagccattgctaatttgttataacttactgcataaagagagtttgatagagggtttcatgatctctcaacaaaatacgaagataggtagatgatagtaaagttacagagaaaacaatctccaatattcacctgctctataggactaggtcatggaatacctttacaaaataaagaaatttggagattgtcttttttggcaaataatgattaacatgcatttttttggatagaatcaatttttgggatgtcacaagggttatataatttaatgctgataagaaacataatagtatcactgtttctctcattttgaaaatgagaagactgtgagctagagagaatacatatatcataatttttctaagatgaacaaaaagatcaaaattttaaactcttatcaccccaggctatctctgtaaatgatctttttaatttattacctgcttttggtatatatttccccagttttgtatgatttgcagctttttaaaatattctgattctttccattctaagcaaagaagaagtgcatttttctccagaatgtaagggaagtactcggcatttgatcttaatttcgctttttttacagtgtagaatgaactacagataagaggggtggaaagaaagaaaagggagagaaagccaacatgagcaaatttctattaattgtcagatcatgacacattccagccaagaatgttcctatcttcttatcaacaaaagtaaaatttactctctctctctcttttttttctcttgtaaaaatagaaacttctgacttgccttttaagctcaaaatcaaacatttctggagcacctagtatgtgagaggatcattttctctatcaaacatcttcccaacaatattatgaatgcaaagtattatgcagaattgtcaaataaactttaacaagttatgtatctgatccagattcacaaagaaatccaaactccaagttatcatgacttcaaacttctatgcctttgatattttatgtatcactagatgatattgtgtctttcaaattcctaatgtagaattgttggtaaaatgaagctctctagccaaatttaaattgacctacgagttaataaaaatgtgctaatttctaatgcaaaatcttatttagcatttttaataactaaaacattcctattgatatttgctcacaaaattattttattgtctaaaaataaattgctcagtaatgtttgtttttaagcattgataataatttgaggtggagtcttaattcttgagagaaaaacctgttcttaaaatcctgcagggcaaactcaagcattagacctttatttctcaatatgttctttcgctttttttaaatgaaattgccaaaaaaagaatagattcaaatttaaactaaaagtctagaagctaaaaccaagctaaacaaaataacactacattaaaaatataagtagatgaaaatgtgctatattttcttgtccacttcatcctgtgtaacttgtcactgagcacccattaatttcttttaaattgtttccttcactttcctcttgagagctggagtgttgaatctagcagcagatcacagctacttataaacacttggctgaaggactctcaaattctctgcaagattttgagtaaagtgaacctaggaattctgaagggacaccctttagtcagtaaggaaagagcgttcatctattccttagacttgttgctgctatcacagaagtcaaagttaaaaacacagggtatgaataccagtactaatttcctggactgattatcaaggagctgtcctctttcatggtcagaggctaatataagcactcctacaacaaaagcaggaagctttgtttctattttcttacccataacaatctttgtcctttattgatatgggagataaaaagtggtgacaatatcagacaaaaggaaagaaaagaatgcgagctttcatttttcctctcctgccttgatgagaagcagtcaaatgcaaccaaatgcccttggccatgtgaggttgggatagctcttaattagtctgcaactccaaactatcaaaaggtagggaaggcaaggatcctaggaagaaaaaccaaatactcacagacaattaaaaactaaagcctaatagttgattaatgaaatgatgtcagcctgcatgaagtgcccttatgactttgtacgaatcccttacgctgtcttaataacttggatactgatgtcaaagaaggtgtgcttatcatttttggcaaaggcataactatgagagacagagttaatatatttgaaaaaataatgcaaatttaattcaaacatttaataataatataagaaattagatgttttctcacaagataaatttaacatagatagggataaaagcccacatttagtaaaagggaacatatgaaagcacacatatttacacagatatatagggagagatgctacttaacaactgtttatgtacaaaaaatacatgagcgttttagttatttttagcacaacacgagtcaatagcattatgtggctactgaaagcattctcctataatttcagttagcacttttagaaattgtgctaaagtaaaacaagaaaattgttctattgcattctttgtcatatcctttagcatttattataactcagtatcattaattcattttttacttatttaatgtgaatctgttccattagattgtatgcttcatatcacacttgttttattcactaatccttgttcaacctatgcctactacagtacatggtccaagatgtatgtccttggtgtcttatatatagtatatgaggaaaatttggtggggtaatgtaaaggaagtagacgcctgggtggaaacgacatacattatatcccaggaaacaggcccagaatcaatatgtagaaaccagagaatgattaacttaaagtcttaaagattaattttagaatacttagaatatcatatgttgtaactattctaaagtttataagtagtccaaaatggagtagactagacttctgtttaaacatggtggaataataatacttttctttctatggcctaagagacaccaagtcagctgagggcacaagcactaacaaaacaggaagacagtgatgattaaatccttattctggctgggcgcaatggctcctgcctgtaatctgagcactttgagaggcagaggcgggcagatcacttgaggtcaggagtttaagagcagtctggccaacatggtaaaaccccatctctactaaaaatacaaaaatattagacaggcatggtggtgtgggcctataatcccagctattcaggaggcggaggcgtgagaattgcttgtatctgggaagcagaagctgtagtgagccaagattgcattgctatactccaccctgggcaacagaacaagacaccgtctcaaacaacaacaataataacaataacaacaaaaaacagacaaaaaaaataccctgcctgccaaacgtactctgtcatgaagaaaattggaaggcttttatccaaaagtgggacaaaccaagagaaaagatgcgacattgccatgtagttgttccaaataaaatggggacaattatttggaacaactaatgttgttctggtcactctacagcaaggatcatcattcctcaaactatgtgataagaagttccaacaagcctttagcatctctttcttaaatattaatggatattcagtgatgatcagatatgtgagcagagcttctaacatgaaaggaacaatagtaagaaaactaaagaaatagaacatgaaagtggggagtataagaagaaaaatattaatatccaaaatgaaattttaaaaattcttttgttaatgacaagatgatatcaaaaggaacatagaatccatataaattatgttagacaaagttgaagacattgaaaaagaacaagaaaacttaggcatataatataaaaggagaaatataaaacaaataaaagatcaattcataaagatcaagacaaattccaggaagaaagaaccgagaaaatgggaaagaaacaatctatgaacaatagatggagaaaaagaaaatgatttctgctagggcacatcattatgaaattcccaaatgtagaaaataaactattccaaagaagaaacagcagatttgaaaacagaggatggaatctcagaaagggtcttcataatggcagtattagacattagaagacattaaataagcatcttcaaaatactgaggcaaaataattagcaagctagtgatccatatctggccagcagagcttattagaatgaagacatcttcagacacacaagatctcaaaacaataactttctcaggaaactactagacaatatgttgcgggaaaaaaaaggatgaaaatcacaaagaaagttgatatgagattgatgtctaggaatcagaggatccatcacaggagagatgaaaaaagagtcatcaggaagatagtgaagggatattccaggattccattttttagcagtcccagagagtaactaacccagataaaaagaagagaatcgtaagctctcacagtgaagtgttcaagctaaaaataagtgtaaataaataaataaatacctctcttctcccccaccaaaaacaaaaaaaacaaaaaaaccctgctaaaataccagaccctactgtgacatttccattctactagtagagtttggggataaattcgttgtcattacagagaatagtaagaaaaaatttcaggaagaatgagtcattaaccttagtgaaaccaatattgtatcaagtaaaacaatgtaattaatggctcagctgtgaataatatttataaggtcatgaatagtgaaacgactgaaaactgattaattttaaaaactgaaatatgccatattgaatggttggaatgaatagttaagagctacaccatcatttccattaatcagaaattaatacagaatatctaaaattacaaaatcaagaaatgatgtacaacagttatcaattgcagaatattcaaacgttttgtagcttaaaacattaagtatttattatcttacatagtttctgtggtcaaaaacatggtactggcttcagtgtgtgaactgagtctctcataaggttaaggttaggatgccagccaagcctgcagtcagtaaggcttgactggtactcaaggatctgtttacaaagtgactcagtcacatggatggcaagcacatactactgttggcatgaggcctcagttcccctcacccccccatggacctcacctgcataagactcaagatatggcggctgcatttccccagagtaaatgattcaagaaagggcctgtaatagggaaatgtcttctatgactagtcttagagggtacaagttgttatattcacagtatactattagttactgagatcaaccctattcatcatgggagaggacttcatgtgggtaacttaccatggggaacagaggatgatatgggccagcttgaaggctatgtaccacaagcagtatgagtgtgtgtgtgtgtgtgtgtgtgttttcaacatgaagtgaagtttaaaacgatttgcattacaaacataaaagagctacatgggcagagatcctagtacttttaaaagaactgttttataattatccatgtgaatgaaactacaggtctgggaccttcttttcctgaaatgcttgtatatattgggcagcttaatttgtttactttgttattattgtaagagatcttgagtaacctgacaataagctatatgtgctctttaaattctatatatctgctctccagtaccactaccttggtgcaggcagaagtgagtacttggaattggctttttgtattattattttgaaaagaaagaagaagaaaatcagtaaacaatagtgtcctaaatgaatatctttagaaataacccttcttagtagaccattgatattcttcggcatttcaggaaattaatccacccacttgataatggttgaaaattggtatcttaagacacagttgtttctcccaacatatcgatattatatcagactgatgtatcttgcattctcccagtaaaaaggaaatagaattttaataaaagccagattgtgcaactaatactctggaattgtagtgcattttttaaaatcttcatgcaggaaatgaaagagaaaaaaagaatccagatcctaacttttcagtagaagagtgaaatgtaaaatgattttagaaaatagattattttcaaatttgtattcttcacttttgaagaagagcgtattttcctcctggatacataatttggaaacatatttcaaaaaccgaatcttaatctatgcaatgaacatatcaaaaagtaaattactatcttcaagggaatgaaatatcatattagagaagcacactctagcaccacagtaattatggctttgccaacatttctgtgcaaagtctgattctgaaacagttttttcttaccccacacagccttgtttatgtaagaatttagtgtttaccccaaccttcaaatacaagttgacctattgttttacttctttaagtgaaactttttgggactatatgactttctaacttcctccagaaatatgtatggttctggatttcctccgtgcttcatctactgtagcttacagaagagaatgttatagaattattgcattttagaatcgaactttgaagcatgttactgaagccatatcatgatgggggagcagtccagaaatatttttaaagcactagtcttggagtcagaagctctgtgttagcctacctacttattagtagggttgccttgatgaagtcacttgattttctgaaatatttctctctctctctctcaaaaatctgtaaaatggaagcaacaaactcaatggcttttaagatctttgtaacctccagtgttactcaagtttgaatagagagagaaggtgagaaacaaatctagaatacacatctcctaactcccagtttggcatattcacaaatgttagatttatgatgattagtgagaaaatataactattccaaatacatttctaggtatgtgagatatattacaatatggaaggaaaatgataccaaattgtggctcttctctatggccctcatcagggaactattctgaaataataggacatgtgtctaaccaaatccatatttttatatgctcatcagcttctaactatgtacttgacttgatctattcttaatgtcaccaaattaacatcttgaggaagcatgaaattttccaaaaagaatctatgagcatttggtggctatttgccagaaatatttctcctggacaaaagatggaaagccattctggaaagcaagagtgttttattagaatacagcagtgctttagtttaatgtgatcattacccttgtaagtttctaatcaactatttgcaggatggttttacaaatatggtttgactaacctcaagccttattttttgcatgcgaaatctactaaaaaatgcaacattatcattattgcatttacatatttcttccacatgtataacaaagtagaatgtatctccctcgttcttaccaaaaacctctaatatagtgacgtgttctgccaaaatgtaataaatgagaaagcatatgctttgcaggcagacatactgggtatttggaatctcatttctgcacttcttagctattatgttcctgggcaagatatttaatgtctctgagcctcagttccttcctctgtgaaatgagactaataatactgctctcataaagctgtattaatatatattctaactatatatgtgaaattacataaaattatgaaatagagagagtggtatatttagctccgttagatgcattaaaatgctaaacatctgtatcttttttttttttaaccagttttctttcaatcacgataaagtcatgacaactggtaactttaggaataatcttaccactaggcagggttgataaatcaattgtataaaatggtacataaatcaaagcctatgtttctctttttaatgtgtgtagccacaactactacatgaccttcatgctttactgctgagagaatacatatttagacaaaagctcaaggagttgcattctactacataacatgcagtggtttgtttctgtgactcgctgtggaagtgatttctaggagcgccagatgcttggatgctatttttatatagatagaaagggaatcccttcatttattggatgttcttggcatggtattgtgtgatttggtgcttgaccaggtgggagtctcttatttatgaagttcagaaaattccagtgcttagccaagtctctactgaatgcccaggatatacttgaaggttaacagtggcataaagtattagtgtttcctgatttttatatgtggatagaatatcttttggctcttggtttatacagattcttgcattattctctcatgagctcagttcttggccttaatgcccttgagttctttagggctacttcctccagcctttttgtctgacatcactactgcctctccacgatgtaaaatctgcactgtgattcaaagagatcccctgcatatagcagagtcattcttccaatggtttcctctttctttttcatttcaattcccacaagcctccatcttcagcaagtctgttgctgacaggttgaacaaatactgctaagatatatttattctctgagaccctttttcacttagagtaaatatgttactgtctcagttcatgttccagcaaaacgcagactctaaggtatggatttcagtacaaagagattacttggcaggtgatcttaagaaataccaatgagaaagtgggataaggaagaaaaggtacaataaaggatcctttgggaagcctgctagcactgtgggcaactgagattgaatcctttggggagcactggagaatacttaactgagagtgactcccatgcctctccacaggagggaaaatagtatactcagtccctgatttaaagctgatcccaaaggcattaattaccaataattctgtagactgctgatggagagatccaaaaaagctttggggcagagcaacacagctgttcagctggaattcagggcatgcactgaaatggtaagagacaatgggataggagcagataaccaaagtgtctaccataatcacctttaaaacatgctttatgcaattatagaattggaaattattttagagaccagctctcagcttatgagtcacaacaaggttattgataatatcgtaggtgggataattctttattgggcagagttagctccgtacattgcaggatctaccactaagcaccagtcagacacccagttattttgactgcacaaataaccatttatattttcaagtgcccctctgttggtcaacattttctctgagcaccacagttttataggggaaggaattttttttgtttttggtttttgggactgagtctcactttcttgcccaggctggagtgcaatggcgccatctcagctcactgcaacttccgcctcctgggttcaagcaactctcctgcctcagcctcccgagtagctggtattataggcatacgccaccacaccagctaatttttgtatttttagtagaaacgggttttcgttatgttggccaggctggtctgaaactcctgacctcaggtgatcctcccacctcggccaggcgtaagcaaccgtgccaggctagggggaggaattctaacttggcaaggctaagagacctgctaaaaggcaattggcaaccagtgtccacgtctccagaattatcatagagagaaaacagaaaccttctttttgagggagatcatctctgagatatttttacctgggtagcagtgaatcctggatacacagaaatataatataatatttgagtgaaataagtattaaattattatgggagctaaacaaattgccctcaattccctatctgtgcatttttatctgcttttaaataatataaattattattacctatgtccacatgcagaggcagaggaaaagagaatccctttaaaatgattacaagccaacaaaatatttgcaagtgaaaacatatattttgggggaactgccttgttattttaagtttacattatacctactttaattccagaatgtcattacagaggaaaaaaaaaagcttgattagctgagtaacatcacttttttaaccaatgcactctcctactgcttagttccttacagctggataagtgggtaacctttgtgtccatagattcttaggtagatggaatctattgggaaaggaaatcaattttacacatatacatacacatatttttaaatttcagactgtttttatctaaaatagaagcacggattttgagtccccccaaaatggatattatttgtctcattcgatggacttactataaattctagaatggcgggatgttatgaacggcatcgcacatgctacacaaacacaaattctgctcttacgattacaccattacaagataaatgtattctcaagtagctgcagtattctattaaaatgtagacacaagcagaatcatttttattaagaaaaaaagcagagcaaagcatttaaaatataaataaaatataaaaacaattgctttcctattaaatacaaaactagagagcactgtttcaaattggtaagtcatatctgtttaatatgattgcaattatttatggggattaggaaaattaatgtcaaatctaatattttcgaaaaatggaagactcaattaattaaccagacatttcatcctggaatcctatttctttttctttccagagggaacctaaatggagattatattagagaattaagtttgacagttaatttatgaagaactaatattataagtatcaattaaatagaggtgagggatatatggaattagtttgagttgttaaactgaccatttcaaaaattagaagtattttatcactaatacagatttgagaaattattagcaattctaaattattcagatttgcttaaattcaatgattatgatttagatgaattaagaaagttactcagtttgtttaaactgtggaagttaactttagtgtcccaaacctgggacattagcttcattttatttcggctatgccaggatatatttgaagctcgtattctgtacaacagtgtatactattgtagagaatggggatggataataataataaaatatcactttgtcagtaaataaatattcactgaatgataattgtgtgctaaggaatttatatgtatattatctcattcaattctcataaaatctgtgtgatagggcccagtatagttttctgttttccaattgaggtaactgggtcacagagaatgaagcctcgcaaccatggttatgccgctactatgtaaggaatttgctttaatcccccagtatccctactctaatctaagtcagaatctagacatgcagatcaatacaaatacatttcagcctaaaaaaaaaaaactctgaaagcacatttccaattttgccagcagttagttattcatctacagaagctattagtcccagtttgtaacattagcaaaaattaattttcagtctttttcttatagtttgtcttggtagcttttgacaaagttggccataacctctctctggataggtgacaaggtgcagtagtgcaccttgtctttcagaacagcaatactcttctggttgacctcttattcctttgacagtgacttctctgattcctttagaggtgtctcttttaatttctaaaaaatgctgatggttttaatgtgttatttttatgacacatatcccccttgggaaattgctcttgttcaaccaccgtctcatgctactgactgcagtgtagactgctctatgttcaatcatctactggaaaccaccgttgaaagcttgaggtgcataacttagacttatattttctcaaacctgctctcatactcacttaccctcactagaagtcctctttactcctccctcttttttacatgtccccatgttaaatttcattattcagtcttgattcattgattaattatttataatttataattttatattttagaatttttttcaggtgctggggatacaattatagacatgattaagtactagtttcatgaggcttatacagtagttacccccttaaccatggagggtacattccaagacccccagtaatgcttaaaaccatggatagtaccaaaccctgtatgtatgtatgggtatatatatattttttatatatatatatatatacacacatagcatatatgtatatgctatgaatacatgtatacatatatgctatgaaaacatgtatacatatatatttatgcataacacgaatgaagaatgcataacaagaatggagcaatgcatttaaaatataaataaaatataaaaacattactttcatattaaatacatatatgtatgcataacaatattttggtaaactatagactacataaagacagtagccctataagattataataagatatttttactatatcttttctatgtttagatatgtttagatacacaaatatttaccattttgttacaattgattacagcttttaggacattaacatactgtcctaggagcctaggatcaataggctatactacatagcctaggtgtgtaggaggctagaccacctaggtttgtgtaagtacactctatgatgtttgcaaaacaaaatcacctgaaaactaacttctcagaatgtacccccatcattaagtaatgcatgactgtgctgttttttcctttatgtccatacctatgataaaatttaagatataaattacacacagtaggaaattaatcacaataactaataataaaatagaactattgtaacaatatactgtaataaaagccatgtcattgtggtctctctctctaattttattgtactttactcacccttcttcagatgacatgaaattacaagacacctatgtgataagatgaagtgaggtgaatgctttgggcattgtgacataacatttaaaacttgaattatttctggacttttccatttaatattaagctgctgttgaccttaggtaactgaaactgcggaaagcaaaaccaaggataaggatggtctcctgatgagttagggttgagaaaacaaatctgtaaagaaacaaataatatgctttctactagggatgagtgttttgaaaaaacataaaacagatgagtaaataaagagtgaaaaggcatagcattttatctaaaatatacattgagtgcaatgtgtcagttgagtgaactatcttggttgcaaaagtcattaaggctcttaggagtcgtgaaagccttctgtgagaaggtgattttggtcacagtaatgaatgatgaaatggtggaattaatgaagagttggtgaaagagacaaataagaaggaaagcaagtttaaaggttctgaggagtgaacaatttggcacttcccatggtttcatttaactgtaagatttgcttccgaaaatatttctgtctttggtatcacttgtcttactaggtactgtaggctttgggctttttctaaatccagtattcactaagcagtcagagtttctggtttatctacacatacaaatccgtttatatgatttcagtgcttatacctttctagatttccatgtacaactgtgcactgcaaaacactaaggaatagcattcacttagactaggatgtaagcattactccatggagttgtgtgacatgctggccctaaattccgtgccatcgatagcgggaggaagtagaaatcctttgacaattattttcctcttgatctaggatacaccctttgctggagtctgatttcttataattttctactactacatgctacattgtggtagtttatggttctgttaccctaattcccttcctcctccctgtagtgacttccttttctggttaacacgttttcattctttgaacttcagctcagataaaacatatgtggagcagacttgccaagtctagattaaatacctgtggtgcaacactgccaaattgagagacatttgtctctcaatttttcatatcatttgtagtttttttttttttaagacagtctagctctgtcccccaggctggagtgcagtagcgtgatctcggctcactgcctcagcctccccagtagctgggactacaggtgcgtgccaccacgtctggctaattttgtatttttggtagagatgggatttcaccatgttagccaggatagtcttgatctcctgacctcatgatccgcccgcgtcggcatcccaaagtgctgggattacagacgtgagccatcgtgcctggccccgtttgtagttctaaaattcaagtctggatatattagttccccgcttaaaatgcctcatgtcttcccactttctataataaaaagtctactatccttcgcatgacattgcctttattttaaatctccttacaattctcgcatctttttcttgagagtcccattgtcaagtatacacttacggtttcctgactaggccaagtggttcccagcatagctctgtgtaaccctctggaattctacagtcacctgtccatctccaaaggctcagtcaagtgtcacatacactgtcaggttttttctgacccaggcatagaactgcccttctcagtgtctctgcttttctctgtgtggacttctatcacaacacctattatcatttactgagtttagtcgtttgtttttctgtcttcttttgtaaactcatggaggatgagactttatttctgaacagtggagacagctggcacctgagagttgcttatttgagtagatgaacgagtgatttaaaaaatttgggaaggatattgaaatgaacctaattgtggtaatcatattcttaataaatacaaactgagacaaaagatttattctgtgaattttgttttgccctcaaaataaagtagtatctcatttcatacgtagtatgttggaatgttttgccatggctgctatactgattggcattgctcactgctgttcgttgcaatatacaccagctgtttttcagcagaatgagtggtacaccttaaaagccaagtctttctccccgaacagagcgctgggccaggctcaaatctgtcatctaatcactcactgtgtgctgaacactagtctgactttccacgtgatctttctacactttttacacacacgcccacacattatttatgctcaaaagaatgatctgttatgagagtacagtgaatgtgttagtttcaagagataagattgtccagattcagaaacttgtagctgtcatcttctagtttcctcactgcaagtgtggagtaagattggtataacattagttcatcattcttttcagattagaaaatcttacatggtcatctgggagaacagggcaaaacaaaggtcaaatgttatggctagaaatcaagcctgcaaagcaccatcaatggaaaatttgtcatattttatggagaaactataattcttacaaatctctactaacagttctggttgtgttgatgctttggactgtctagagagtcacactcttctgtccattaacttaaaagcatgactttttagtatgttcatttccccatatggggtacaagattagtaatatcgtcttttaccaggtactttctctatgatcatggacatttgcctattctaatcagatccctgcatagttatttaggtaacttccttgaagaatatagtactaaggcagaatgaccatataatttattattgaagttagataactttttgagagcgaagaaagcagtacccatagttaccccaggatgacaggcataaattgaaatacgtggtcaacgtagtatatgggagacatgacttttaggagaaaatatttccaaataactcaaatcttaaaaacctccagagacttcaaacccattctgaaaacataatttgctgttcatatctcaaaataacatggttatcacctggggatagaaagatcatgacaacactgatgtgtgccatgaaattctttccatacttacatgaggttgtcaggtccaaactccaaatgcagaaaaacatgcagagaattgtagttcttgagcatctcttcttgaattagagcataacaattaacttttaaatcatttttggatactattgccaatgctttttattttgggtatctttttaacttaagtgctagctttcagaagtggaaagaaggataaatactgtaattatccttctattataaaatattacatttttaattacagcaattatttctagctacaaatctttaaatgtatgatgttttacttatgtttgataataaataggcaatactttgtgatacacagttgacacaagacaaatctaaataaaaaatgagaacatgagcccccttaattttatggattgttttttaaactgactttgcttctatgcaggcctttcactttctgtaaacacttaagggatattttttaatactctgtaaagtaaatttcagaatggaaaacataactccgaggtgtattttcaatccgcacaattttttttcacagaggtgtagaaaacattctacctgttattaaaaaaaattctatgtatttttggtttgtttgtttgtttgtttgagagggagtttcgctcttcgtgcccaggctggagggcaatgttgcgatctcggctcactgcaacctccgcctcccaggttcaagcaattctcccctcagattcccaagtagctgggattacaggtgcctgccaccacgcctggctaatttttgtatttttggtaaagacaaggtttctgcatgttggccaggctggtctcaaactcctgacctcaggtggtccgcctgtctcagcctcctaaagtgctgggattacaggcatgagccaccacgcccagccacaaattctgtgtttttaatagctttattgagatataatttacctgctataaagttactcatttgaagtataaaatttaatagttttagtccatttatagagttgtgcatcatcgtcctaatcttgttatagaacattttaaccatcttctccccaaaaaaccttgatcacattagcaatctctccccattccctctgctgtccacccctcatgcagcccccagccatagacaagaactcatcaactctctgtctctatatatttgcctctttggaacatttcacaaaaaatggtattatacaatatattgtcttttatatctggcttccttcatttagtatgtttttgagattcataggtgttgtagcatctatcagtgcttcatttctttcactgtctaatagtgttccatttcttggatatactacattttatttagtcattcctcagtgggatctttgggttgtttccatttttgactcttaatgctgccatccacgcaaaaggtttttcagtgtttcattttattgtcttttttttttttttttttttttaacgtatgttttcttttctcttgggtagaattccacctaggagtacagttgctgagtcatatggtaactctctgtttaaccttttgaaaaattgccaaactattttcaaaatttgctgtaccatttcacattcccatcagcaatatctgaggatcccaatttctcttcatactttctaatacttctacatcttttttaatataggcatttcagtggatccctaatgataataggcacttctgattgtttttgtaaataaaatgttattagaacacagccacccccattcgtttattctttttttttttttttttgttttttgttttttgagatggagtctcgctctgtcgcccaggctggagtgcagtggctctatctctgctcactgcaagctctgcctcccgggttcatgccattctcctgcctcagcctcccatgtagctgggactacaggcgcccgcccccacgcctgactaacttggttttgtatttttagtagagacgggctttcaccgtgttagccaggatggtctcgatctcctgacctcgtgatccgcccgcctcggcctcccaaagtgctgggattacaggcgtgagccaccgtgcccggctccattcatttattcttattgtctatgggtatttttgtggtatgatggcagagttgaaccacagagacaacatggctcacaaatcctaaaatatttattttctgaccctttacagaaaaagttcaccagcctctgctttagcgaatcaaaaatttacgtcctcaatcatgttttatttacaagtgattggcgtatgtcaggatgtttagtgagcgatacaggagtatttcattgtatttggagggaatgattgaaatgattttatacagataatcttctgaatttgtgattggtgttatatttcaatttatcaatttattcatatttatttaacaagttattacatatatatttattcggtatagttgtgaaagtcttattatatgccagtggctgtgttagaatttaaggataatgcagtgaggagcaacaagacccctgctttaacagagcttacaatttatggaaagactgcctcttactctgaggaaggtgggagtcatccagtctacagtggagctgagggcctgagggaaagaactgttagaacagatcactggtacaagatctgtagttctgaggaggagactctcctctttgtataatttctcagagcctttaccgtatgaaatatgcattgcatatctctagcaagatttccaaggtacctgagcaccagatctcttagtttgatgaagtatttagggctccacgaaacattttctgaaaaaaaaattacatagaacattgttggtcaagaattgtcagatgaaaagattcttaaaagaccctagaaacaaaacgagatcatttactcaacatctttctttttctagtgctacgtgaccttttaatcttgaaatttttcttgtgtagatgttaggcctgtaaattagttatggtaatgtcaattcaaagcgtctttgaagtttagtttgtcctttattggattcctgtctttcatatttgtctttctaaagcactttaaaatcttggagaagaaagttcaaggaaagatgatataatagattattcttccttgggctgcaatacttttaaaaggattattccttatctttttgttaaattgacttctataaatttttcaaagtgaagtgttttggttctcaaaggctaggagtatccttttatcttctttttctattctctcatattttccttccttgacaaattcatggctgaataacagtatcgaaatgttatcataattctttggctaattatttttgtcaagccccccaaaaggcaaaaacaagcactgtttaaaatgtttagtttggcagcatgagataaattagaagtgcagagaatgagcaacctatgagatcatctgtctgctgctacgtgcagcccatcacaattctagactgttagaaactcaagctcaattacccactttgctattcagttcctgcatactttgcgtgaataactgccccactctgtaactcagattcctcagctgtataatcaatggagttaataatacttatttcagttattgtgaagcaccgagtagatggttggcatgcaataaatatagttaccaacctataacattggtctaaggaatgaagaaacatctgttagaaagacagctttttaaatgaaaatactaatagtgccctgaagaaagatttatctttcttagtatgtcacagttaccagatggaaaaatcagcaaaatacaaaacacttaatgaatataggtatcatgatatcattatgatcataaggaaaaaagtggaacagttagatggggttataactggtaaatccatacttgaacgagatgtctaacatttagagtggagttcccctgggtttattaaaggttagtgttctctatcttccccagggagaattttataaatatataaataacgatatgaattacctctttggataaatatataaatgctatttaataaaaaaaaaatgtgtctgacctaaagctggaagggattgataatacgttgaatagcagaatgatgaccataccatatggataggtgatgtggtaaacctaatttgtgagctaattttttttgaagaaatgtgagaaagatcttttttggattcacaatattatcttcacaaatctttgaaagggaaaatgtaagtgtggaaaagacttcagtatttaaaattactgtaattgcaaaataagagttatagtgtgctaaggagatacttctgacaaaaacagtcccatgtaactatagccagatcaaattgatatgaagtatctgcaacagtggagattattgacctattcagttttagacttcattatgacagtgttagtttcagtggagctactccattctgagggacaaagataaacgttaaggtattcaagaaaagttaaatagttgtgggcagttgttgataaaaggattaagacattaagaatagccatgtagtttggaaaatcaactacaaaaaattatatctggaaatatctttccaaaactagctttgacatttttgtttctacaactccatgtttaggcatgtaacatgaaggaatctctcctcacgtaaaagaaatgcctagggttttaaattccagcatagttgtataatattgaaaactacctaaggtgctcattgaataatttatgtataaccactgagtagaatagtatttggccataaaaaagaatgaagaaagttttctctgaactgatataaagtgattaagaagatatatgttgtaaagtataattacagtattttaacttttgtttcacaaataaggaaaaataagaatgtatgatattttttctctctcttgagatatctctatatctgtttgtctatttgtctgaatctgtctgtctgcttgggtatactttcctggccaaaaagaaaaaaaaaaacaaaaaacagaagtataaacagaaactaaaaaatagttacctctgtagagtaggtgaaaatgggatagagggaataagaatcggaatgtaagttccttgaaagcaagaaacttgctttatatagtaaactctttatgtagttgacgttttaattataaaaatatcctatatatttaaacaaacaaaattaaaaggatgaaaaaatcagttgaatcaatcagacatacatgatcttaaccaaatatcaaattatttactaccatactgagaaaataataatttaagtaacttttacttgattaattaatttgtcaattaacgtactaattcatcaacaaattaagattataaattcaggtaacattattcctaaaaaactccatcttaaattcatctgacttttctatatttcaatattaccatttccccatgatttatacatgcttagaaagataaattctaaagtccaatacaactgcaaaaatatcattagctcttgttttttattatagttgtattggtgtggtcattctcacattgttttctgtatatattgtatgaaagaattagtgagtaaatgcattagcatggttggaagaaaggaggcacaaatatggaatgggtatgtgtggaagaatgctttagtgttggattttctttagaagtatcagtataaccctgttagacatagacacatacacatatttaatacaaacttcaagcacattttcatccatcttaaatttatctgactattctatgtttcaatattaccatttcttcttgattgaaggatgtcattatgcctgtttgtgcatataatgaacagatattgatttctaaataccactcactaaacacacattgaaaactgggaaacttaaatggctgatttcaggtctgcaacaagaaagaacaaattgggttatgccagaaagcaatggcatactcaatggttaataggataaggttgaaaaggcacagatgctctgtatagggaatttattgaccacatttggggtatgtagcttcagtaagaaaaatatagaataacatgttgaattacaaaaaaaatccaagagtacatagtaatacaagagataaaaagaaagacaaaaatggcagttcttttaaaaaagaattatgtgattttattagcccttcttcaccctattgctgatagagggattcctactctagtgttatatggatgacagaatataacacctgacactgggcagatgagatcacctgcagttcatacacattcatactcacatatggcatacatatatatactctcagctaggggaggagagcaccccatgccacagaggcccacacaggttgcacttgggaacaaagtgaataaccagggactgtggacagcaagatttatagtgtcaacagagggaaaggccccagtactcatgggaggatgtggttggtttagttatttttttattttaaaatgtaatgtaaattaattttaagttctgggatacatgtgcaggatgtgcaggtttgttacataggtaaacgtgtgctatggtggtttgctgcacctatcaacctatcacataggtattaagtcctgtaagaattagctgtttgtcttaatgctctccctcccctcaccccctcaaagggccctagtgagtgttgttcccctccctgtgtcaatatgttctcattgttcagctcccacttagaaatgagaagaggcagtgttttgttttctgttcctgtgttagtttgctgaggataatggctcccggctccatccatgtctctgcaaagacatgatctccttcctttttatggctgtataacaatccatgatgtattttctttatccagtctattattgatgggcatttgggttgatttcatatctttgctattgtgaatagtgctgcaataaacatgcacatgcatgtatcccagtaatgggattgctagtcaaatggcatttctggttctagaaatgccatttctggttctagaaatgccatttctggttctaggtctttgaagaattgccatgctgtcttccacagtggttgaactgatttacattttcaccaacagtgtaaaagcattcctatctctccacagcttcaccagctctgttctttcttaaatttttaataatcaccattctgactggcgtgagatgcttctcattgtggttctgatttacgtttctcaattgatcagtgatgttgagctttttttcatgcttcttggccatataaatgtcttcttttgagaagtgtctgttcatgtcctttgcccactttttaatggtgttgtttgttttgtttcttgtaaattaatttaagttccttgtaaattttggatattagacccttgtcagatggataaattggaaaaattttctcccattctgtaggttgtctgttcaactgatgatagtctcttttgctgtgcagaagctctttagtttaattagatcccatttgttaattttttcttttgttgtaattgttttggctgctttcatcatgaaatttttgcctatgcctatgtactgaatggcattgcctgcatattgttctaaggttttcacagttttgggctatacctttaaatctttaatctgtcttgagttaatttttgtataaggtgtaaggaggggttcagtttcaattttctacatgtggctagccagttctcccagcaccatttattttacatttatttatttatttagtttttgttttttttctaggtcaagtttttttttattattattattatactttaagttttagggtacatgtgcacaacgtgcaggtttgttacatatgtatacatgtgccatgttggtgtgctgcacccattaactcgtcatttacattaggtatatctcctaatgctatccttcccccttccccctaccccacgacaggccccagtgtgtgatgttccccaccctgtgacccagtgttctcattgttcaattcccacctatgagtgagaacatgcggtgtttggttttctgtacttgcgatagtttgctgagaatgatagtttcccgcttcatccatgtccctacagaggacacgaactcatccttttttatggctgcatagtattccatggtgtatatgtgccacattttcttaatccagtctatcattggtggacatttgggttggttccaagtctttgctattgcgaatagtgctgcaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttctttcctgactttttaatgattgccattctaactggtgtgagatggtatctcattgtggttgatttgtatttctctgatggccagtgatgataagcattttttcatgtgttttttggctgcataaatgtcttcttttgagacgtgtctgttcatatccagcaccatttattaaatagggaatcctttcctcattgcttgtttttgtcaggtttgttgaagatcaaatggttgtagatgtgtggtgttatttctgaggcctctgctctgttccattggtctatatatccgttttggtaccagtaccatgctgttttggttactgtagccttgtagtatgatttgaagtcaggtagcatgatgcctccagctttgttcttgcccagaattgtcttggctatgcgggctcttttttggttccatgtgaagtttaaagtagtttttttccaattctgtgaagaatgccaatggtagtttaatgggagggaataacatcgaatgtataaattattttgggctgtatggccattttcataatattgattatacctatcattgaacatggaatgtttttccatttgtctgtgtcctatcttatttccttgagccatggtttgtagttttccttgaagaggtccttcacctcccttgttagctgtattcctaggtattttactccttttgtagcaattgtgaatgggagttcatttatgattttgctctctgcttgtctattattagtgtataggaaagtttatgatttttgctcattgattttgtatcctgagactttggtgaagttgcttatgagcttaagaagtttttagactgagacagttggggttttctagatataggatcatgtcatctgcaaatagagacagtttgacttcctctcttcctacctgaataccctttattttttctcttgcctgattgccctggccagaacttcaaatactatgttaaatagtagttgtgaaacaggacatccttgtcttgtgctgatttgcaagaggagtgtttccagcttttgccctttcaatatgatattggctgtgggtttgtaataaatggctcttatttttttgaggtatgttccttcaatacctagtttattgagaatttttaacatgaagcgatgttgaattttatcaaaggccttttctgcatctattgagaatcatgtggtttttatatttagttctgtttatgtgatgaattacatttattgatttgcatatgttgaactagccttgtatcccagggatgaagtgacttgatcatggtggataagctttttgatatgttgctggatccagtttgccagtattttgttgaggatttttgcattgatgtttgtcaggcattgatattggcctgaaatattctttgtggtatctctgccaggttttggtatcaggatgatgctggctgcataagatgaattaaagagaagtccctctttttcaattgtttgcaatagtttcagaagaagtggcaccagctcctctttgtacttctggtagaattcagctgtaaatacatctgatcctgggcttttttttttttttttttttttttgtggtttgtaggctattaattagtgtctcaatttcagaacttgttattggactattcaaggattcaacttcttcctcgttcagtcttgggagggtgtatgtgtccagtaatttgtccatttcttatagattttatagtttatttgcataggggtatttatagcattctctgatgattgtttgtatttctttagggtctgtggtgatatcccctttatcattttttattgtgtctatatgattcttttttcttctttattagtccagctagtggtctattttattaattttttcaaaaacaaactggattcattgattttttgaagggttttttgggtccctttctccttcagttctgctctgatcttggttatttcttgtcttctgccagttttggggtttgtttactgttggttctctaattcttttagttgtgattttaggatattgatttgagctctttctagctttttgatgtggacattttagtgctacaaattttcctcttaacactgctttagctgcatcccagtgattttgatacattgtctctttgttctcattggtttcaaagaacttcttgatgtatgccttaatttcattatttacccaggagtcattcaggagcaggttgttcaattttcatgtagttgtgtgcttttgagtgagtttcttgatcctaagttctaatttgatggcactgtggtctgagagactggttgttatgatttcagttcttttgcatttgctgaggattattttacttccaattatgggatcaattttagagtaagtgccatgtagcactcagaagaatttatattctgttgttttggggtggagagttctgtaggtatctatcaggtacacttgctgcagaactgagttcaagtcccgtatatccctgttaattttcaattgtgatgatctgtcttatattgacagtggggtgttgaagtctcacactgttactatgtgggaatctaagtctctttgtaggtctctaagaacatgttttatgaatctgggttcttctgtattgggtacatatatatttctgatagctagctcttcttgttgaattgaaccctttagcattatgcaatgcccttctttgtcttttttgatctgtgttggtttaaagtctgttttgtcagaaaactaggattgcaacccttgctatattctgctttccatttgcttgttaaattttcccccatccctttcttttgtgtctttgtacgtgagatgggtttcttgaatgcagcacactgatgggtcttgactctatccagcttgccattctctgtcttttgatcagggcatttagcatgtttacatttaaggttaatattattatgtttgatttgtgtgtccttggtctttgttcttcagtgtgtttttgtaatggctgttaacgatttttcccttccatatttagcccttcctacaatagctcttacaaggcaggcatgatggtgacgaattccctcagcatttacttttctgaaaaagatgttatttctcctttgcttttgaaacttagtttggccagatgtgaaattctgggttggaaattcttttctttaagaatgggagaaaatttttacaatctacccatctgacaaagggctaatgtccagaatctataaaaaacttaaataaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacaatgttggtgggactgtaaactaattcaaccattgtggaagacagtgtggtgattcctcaaggatctagaactagaaataccatttgacccagccatcccattactgggtatatatccaaaggattataaatcatgctgctataaagacacatgcacacgtatgtttattatggcactattcacaatagcaaagacttggaaccaacccaaatgtccaccaatgatagactggattaagacaatgtggcacatatacaccatggaatactatgcagctataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaacatcacacaccagggtctgttgtggggtgggggtaagggggaaggatagcattaggagatatacctaatgtaaatgacgagttaatgggtgcagcacaccaacatggcacatgtatacatatgtaacaaacctgcacgttgtacacatgtaccctagaacttaaagtataaaaaaaaagaaaagaatgttgaatattggccctcaatctcttctggaatatagggtttctgctgagaggtccactgttagtctgacaggcttccctttataggtgacctgacctttttctctggctgcctttaacattttttccttcatttcaaccttggagaatctgatgattatgtgtcttggggttgatcttctcatggagtatcttactggggttctctggatttcctgaatttgaatgttcacctgtcttggtaggttgaaaaagttctcctggatgatatcctgacgtatgttttacaacttggtttcattctgcctgtctctttcagctacccctatcagtcataggttcagtctttttacataatctcatagttcttggaggttttgttcattccttttcattctttttttttcctaatcttctcttcctgttttatttcagcaagatagtcttcaagctctgaaattctttcctctgcttgatctcttcagttattgatacttgtatttgcattgtgaagttattgtgttgtgtttttcagctccatccggtcatttatgttcctctctaaactggttattctgtttaacagctccttctgaagactacttccgtcagtttatccatctcagcctctgcctagttctgtgctcttgctggagaggtgctgcaatcatttggaggagaagaggcactctggctttttgagttttcaacattttttcattgattctttctcatcttcaggagtttatccagctttgatcacagaagctgctgacctttggatgggtttttttgtggggacttttttgttgacgttattgttattgttgctttctgtttgtttatttttcttttaagagtcaggctcttctttcataggcgtgctgcagtttgcttggggtccactccagactctatttacctggttcctttccacacctggaagtgtcaccagtggaggctatagaacagtaaagatggctgccttttctttcctctgggatctctgtaccagaggggcactgacctgatgccaacagaaatgctactgtataatgtgtctggcaaccctaattgagggttctcctccagtcaggaggcaccggatgtgggactcactaactgaggcatgttggctgctccttggtggaggaggtgcactgtgctgggaggaatcccacttgtctagactgcccagattcctcaaagccagcaggggcaaagactaagtctactgatttgcgaagactgcggccacccctccttctaggggctcagtcccagagagattagagttctgttgctaaaaccctggctggagtttctgaaattcttgtagggagggcttgcctagggaaatggtgtgggtaaggatccagcctaaagaggcaatctggccacactctgccacagccacggtgctgcactatggggaattcctccagggtccaaaccatccattttccctggcattgcaggggaaagatggcaaactggagctgcagtgatggcggccacccctcctcccggaactcagtcatcttatgcagcaggcagccacagtgatggctgccgcccttccccttgaaagctcagccatcttaggcagcatgcagccacagtgatgatggccacccctccctctgggaactcggtagtcttaggcagtctccagccgagtagccgctgagaatctgcacaactctgcggttcagacccaaggctctggtggcgtgggctgacaagggggatctcctgatctatgggttgcacagatctgtggaaaaagtgtggtttcccaggcagagtagcaccatcactcaccgcctccctcggctgaaggtggtagctccccttgccctgtctgactcctaggtgggctgtggcaccactctgcttttccttactctccgtaggtcacaccaaccacctactcagtcccattaagaagacctggatacctcagttcagtctgtttaaataattcttcaagtttgcaggcaactgaaactcaccagttaatgattaagtagtagccgcacctgttccatttgataagaaaggttatttggagaggatcttagctctagaagcccaatggggagggaagcttgtggttaagttattggaggccctgtgatttcaccagatatccagtcagcacataattttagacattagttcttaggctttatatcatataataaatatggctggaatgatagactagaaaactcttgatgtttctgtcctaatattataatttattaatgaaagaattatcaatacattctaaaatcattgggcaaaaagtgtttaagaatagaatattcatgttttcaaagcatcattgcacatattacttgaaaggtggaacatgtccctttaaaatggaaagatcatacagtgacaatcttaaccaagtggctaagtttggcattactgatggtgtaaagcctaactttttgtttcttctgatgacatgcaatgggagattcactacaccagttttgtggtattcttaccaaaaatgttgacctcagtctaatcgcaaaaaaaaaaaaacaaaaaacagacaaatctatgatggtatgctttgcgagacagctaccctgggcttctcaaaaagttaatactttaatattaaatcaaaatatgtaataatgaataataggggaaaacatcaactattttaaattagataagactaaagtaacgtaacagtgaaatgcaatgcatgaagttgcatgacagaccgaaaagatataaagaacatttacgtgactattgatgaaatgtaacgtaggttgcatgttgtataattttattaaactgtttatttttctcaggtgtggtaatggtgttgtggttatatattcttgggaggcccatacttaaatataattgtgcaatctcctttggatcattcaacaaaacagttgtgtgtatgtttatgttaaaagagagaaggagacagagagagagaaaaggagagagacagaaaaagagagagagtgagagaaggagagaaggagaaaaagtgagagaaatgaagtatatatggaaagatgttgagaattagtgattctaagtgaggattatgcagatctttattgtactgttctttcaacttttcttcaagtttgaggtttttaaaagtaaaaaaaaaaattaccacatagctgaaggtgaaaacataccaattatggtggataaataacttaaacagggagtcagacttctgctcacatcccttatcataataaaattgcagaatctaagaggaagtggaatcttaagagattttagaagaaaggcagtctacagaagacaagcaatttaaacaggcctctcagcaacagccattagaaacctaaatacaatggaatgtaacttcagtgagctgaaatagcttaaaattctgtacctagccaatacacttttcctgagggtaaaatatatgtttgaacagataatctgggataagccaaaaacaaatactcagtaaaataaatgttaaaggtataatgtaaacagaaaaaaaaatccagatgtgaaagtaatgatacaaaaagaaattatgagcaattatattggcaaaaatgtgactaaatcaaagcaaattatgactatataaagccaaagtaatttgaaattttgtgaagaggaaaaatatctttcaaaaaactgattaaaaaattatatacacaataggaaggggagtaaagtaactgtatactatggcttttgagtagtttgaagaggggtaagttaattgtttttaaattagcataatcacaaaaaatatagatgcaaagtacaaatttctaaaaatagaggagaaaaatagaataagaaaataggaggcacagaattgagactccaagaatatgaaaaatacaatccaggtgatagagtaagattgggcaacagtgacagaataaagattgaggaataggtaaaccaatgaaatatattgttaggagagcatttccaagaccacaaagaaacttagcagctctcaattataaataaaagttattttatgataatactaaaactcttattgaatttatgagtgagccccgaaatagaacatgtttcataggcataagacttgattaaatcactattttctctaggagggaggcccctgtgacctggggggaagcctacacacagctctcactgatggacaagaacagtggccatcccagtcaaactaaacttgtgtgaagaaaaattaagcctagacatcaccagtctgtgacctctagtaccacccttgtacctgtatcacattctactggtataactcaaatataagttcagagtgaaagcactgaatcatgaaactaagagggtaacctgtagaagaagagccagagatctgattgcatgttaggcttcactctagactgtagcctctgaggattaataaaatctttggaatgcaaagatcacttttcctctgaataagatttgtgaaatctctagaattatgcactttcatatacatctgtggttctgcctaattttaatgggtactgccttctgattctgtgggaagaaaatatcatgggactttgaaatccgtcagttgattgcacatttcttgttcagtcaaaatttacttagaattccaagtgtgcatttactaaaactgtgcttgaagggttggtagtgggtgattttaattctctagtattatatgtgattgcagtctggaaggctgaactattttggtgatggccaaccatgcagtaagaaggttaacacaatttgcaatggtaatctctctttcatctacacatttcagtcaaccttggcattatctctaaggccgaatccaagtgcctgtaagccagaagccttcaggaaagagcagctgtttttgtgctctctcacatcttgaattctaggtcaaaatgtcatgtaaaagttttttcactaaaatatctatattgatttctaggaataaaatagaaatgcctggaggattctgtgtattttccctgtaagtcactgaaatatcctggtaggccatcaagaaataaaatggattttgtctccattgtatgattgagtcctcccttgaaatccttgctattatctggaccaacaaatgtgtagagtccagactaagagtggagttgattcagtgtatgtatccatgggattttggtcaacaaaacaggactacttaaagccttgttgggtaggggtttattataggaatcagaccttacacaaacacggaagcactaactgaagagaaagtgtttaagggggactgggatgatcagagaaagaatcactggctggttttcctgaagcgctgactcaggtagacaagaagccaagcatgctctactgccaaagtaggactctgaagggggcacttcagcaaggtctgtaggaagatgttgtctttggtggccactaccactgtgagtccacagccaaatgcccagtggtaggtttggggccaccattagtcagcagggccagctactgaaaaggtggactagattcagagaagaggagaataaggatacactgagtcttgctgggtacccctctacgtatcttaggcatctatcttatgaaaaccttctgaaagtagtagcttctgtttctcttcttccttccatatctcactgaacgtctctcttctggccaattctaatgtagaaatatcaggaaagggtattgggaaatgtaatactccatatttgcctgacataagcaagataatctagttagaagctggcaatttccttataacctaggacaattaggaagtagaaattagagtctaaagcagtctgcaaactaggaagacagtggcaaacaggagtaacaggaaacgaagtcaggtgcagtagacaaacatctgtcctggtgttataggttgtgccagtatatgggaggctgagggtcagaaggtttatgcaaagaaccaaagcgaagcaagatttacctctgaaatgacaggaggtcacaggtacatgaaactcaaatgcattacaggtttttttttttctttgttatccaaatataaagagcaggagataaatttcatcaccttttgaggtgtttgttaaaacatgtagatttctgaaacctccttgcagacctaggaaccggaatctctagggttttgattcaggaatctgcattttaaatacaatcctcagatggttcttctgtgcagtctagttgggaaatatatgattcgcagagtgacagattcatgctaacgtcatgtcaggtacttactgatctgcttcagcactgagaacagagactgaattagaggaccagatatataagtgatttttttttaactgactcatacagtagattttttttttttttttagagaagataaaattcaggctggagatggcaaataaattattcatgtcacctacctagtaagtgactgggcctatactctaatttagatctacttgactccaaagtgtaccctttgagtgttgaatggagtaaaaggcttcaggcttgcagaattactgacttgcttgctaaacattcatcagtgagacccctcagggaaggaaaagtaatactggtctcctattaaactaagtctgtgtggatttctaagaaaagtcctggaggccaacattcccccaaataaaagaactagtaatggaggaaggcaggtcctgaaaaaatcactcccaagaaaaatgagaacttcacactcgctttgttttctgccccctcctcctccctctctgtggacccagcacttacaactactatgacctcttccatctttatgtgtcttcatcataccaagtattcccctttcttatctgaaaaagaaaaaaaaagaagaaaggaaaaaaaaaaacgacatcttgatctcgtttatatggaattaattttacagttaataagtaaaacctaatattttttgtctacttttttgggagcaatatggtgaactcatattggcaaagttatttaatggttttatgaaggaatagataagtgtgagtgagaaagtgtggaatcagatcgcagctgtaaagataagctgaactatggcagcgcaatgtgacccctagtccttgcattctaatttaggttctgctgggaagctttacgagattattgaatacctttctagcaattagagctggcctggatggttccggttgccttgggaatttggaaattcttctatgtgaaagatgtttctgcaggagctgatcattatacaccgatgttacaaacaattaatttataaagtacaaagtttcaatttcacagtgtttattttgtttttttctgttagctatctgttcaccagataactatcattctttccatatcttgtggaattcctgctaggactaataagataggaactggaaaatagctttgaaaatagaataattactttgaaaatagaataatatgtattatatgatatacatacaggaaagtactcctgcaacagcaacaattgtactgattctaatatcccaaatccagcggctgctcttcaccctctctcctagcccaagccatcatttctaccagtttactaccacagtctcttaaatgatctgcctgtgttctgtctgcttccacaagagtccatcgtctactcaaagttgttcagatcctgtcatttccttgccataagaggagaatcaggacaagttttgccacggcatcaaggccccgcgtgatttgtcctcacctgttttcccagtgtcatctcctcacagtcttccttggttatctgcatttcagcatcacagacttgctttctagtccccaaatgtgcccacctcatttccatctttgtctctgctcttcccgttcatttccaatactacctcttcagagagacctctttaaaccagcctacataaatgaaccccactctctccctctatcctagtatcctgtttagtctttttattaccgtacttatcactgtctgaagttatctacttatgagtctctatgtgtattattagttttctgctattataccgaagtgcaagctcaataagggtaacgtctttgtcttatatcctcagttcctagaagaatgcctgtcagatactgggttcaatgtgcatgtggaataaatgaatggataaatggaaggaattcaattatatttgacatttggtaggcagccagattcagtgaaattatggaatactggtgcctcaaaacaaaaccttttcttatgtcatttcatatacgatagtgttaccaagtatcaaccttttcagccacacagcctgaaataatgaaatggaacatagtagttggacttggaaccaacttctgccttaagcagaaagctcatgcagaatttaaagcgattattaaggaaagaaaatcctcttcaacacccacagaaagatagggcattgcttttcaagtcataagattttcagtaattagataggagaattataaatatattatttgcatgttacacattcctgtaactctaaccatccaaatatggtttctatattcaaaataggtagcaatttaaatataaatgagacaatgcctcatacatacaatataatatttaacttaaaacaccgagatggttaattccgtgtgtcagttttgctagctacagtgcccagatatttggtcaaacattcctctggatgtctctgtgacagtgcttttttggatgagattaacattcaaatcagtggactttgaataaagaagattaccctcccacaaggtgggtgggctcatccattagtttaaggtcttatcagaaaaaaattgaccttccttaagcaagaaggaatgctgccagccaactacctttgtacttgaactgcaattcttttccgcgtctccagcctgctaatctgtgccattagattttggactctgcagtctccagggacaatagcatggcacagtccctaaaataaatttcccaatcttcctctctctccttctcttcttatttctcttaaattccctttctctttcaatctctctatctccctctctcctttccctatctctctatctctctctctccctctcagtatctcatacacacatacgtacaaatatatgtgtgtttacatatatgcatatgcattatatatatatttatacacacacatcttgtcctgtttctctggagcattctgatacagacacatttctgattatagatttaatatatactatattgtagtttaaacatatagatatatagagagagatttaaaatatactatgttgtagttcaaaatatactattgaaaaaatttacataacctgtccaaatgtttatttggctattaattcaattaaacagattgacctcatctatcatttctgatagattacttctaagaaacagaagatggtaagtaatatctcatgcattatgaagtcatttaaattatttaacatgcattaaaggagaaattcaatgtagctcatttcttcaggtttactaattaaagtcagtcttgactctagaaataaaaaaaaaaatgcgtaagaagagcaactgtgacagcattaatattcagtgaaattgatgaccttagtgggttagttttatataaactgttacggtacgtacaacttgtcactgtagttcaaagttatgttcaacacaatggttcttcttaattgctcaagacactccactgtgacattggctacttcggctgcaatagagagattaaagaatcaagtcattgtattttacagttaacaggattgctaataaagaatagtagcagcatgaaaaattgtagagaggcagtaaaactgaaagctcaagggtctacctgtatagactgcgaaatccatatactgcaccaagattacaaatggtgattaaagaggagcccacgatataatagattaaaacaaaaggttaggtgtctaacagaacactggatgattctgggaggatggggcacataagacgttataaaaacagagttatattccaaggccctttttaaattacaagaattacttgtacttttactggcattagtttttgcctgcaaatgttgctagattcatcatacttttagaaagctgattacaaggttttggtctgttcccatgaaattccatccccagattttgtgacagtagcccttcatttagcaaaaactcatgagtttcttctctgtaccagttgctgatgagcttagtcagttattttttatgctgtcactgtttagggcaaatcaaaccattgtctaaacagttcactttggaatattgtgaaaaaaataaagtagagatccacttaaaaatgttgaatgtggttcttgtctttatctttgttggtactttcctgtcattgccataatcattggctccattagcacctgactggccaatcaggtcagttgactttgttcatctgagccactgaacatttctaaatccagtctcatactgcacatcaactgtggttccccatttgtaaattaaaaaaacttaaccatgtctaacccacaggaaaataatagtttctttttttaaatatatatatatttttattatactttaagttctagggtacatgtgcacaacgtgcaggtttgttacgtatgtatacatgtgccatgttggtgtgctgcacccattaacttgtcatttacgttaggtatatctcctaatgctatccctcccccctccgcccactccgcaacaggccccggtgtgtgatgttccccttcttgtgtccaagtgttctcattgttcaattcccacctatgagtgagaacatgcggtgtttggttttttgtccttgcgatagtttgctgagaatgatggtaataatagtttcttagtttacttgttcactgaaggactggatgcaatggctcatacctataaacccaacactttggaaggccaagatgggaggattacttgaggctaggagttccagaccagcctgggcagcgtagagacactccgtctctataaggtatttgaaaaaaaaaaaaaatagctaggcatggtggcgtgcaccacctgtagtcctagctacttgggaggctgaggcaggaggatcccttgagcccaggagtttggggctgcagcaagctatgattgagccactgcactccagccaaggtgacagagtgagaccttgtctctaaaaataaaaatttaaaaagttattaattgaataggagtttggtgtgggtggagttaacagtcagtaccactaatctccatattttaatgtggtttatataaactataccaccaaagatataattatttatattgaaatatcagcatgcctaacaacataattggattctatgtttatttgcaatatgagtaagtcagaggaaaactgatagagtaggaaagtcagatttcaaaggtgaactgtataggaacttgccctttggtcttacagtgctgtctcctattattttaagcattcaccttaatgataccatgaaaagtattctcaaatgggatcatataggaagccaagacacagactgttttagcttaaagggccctgagaattgagattgttttgaattcctaaacactttccttatgttataggccaagcccaagtcccaaatgtgctttactctgttccactgagttttaaaactttgtatcagttaccaacattgaatattgagagttttgatatagagatagtaattttcaatttatttagaagattagaaaatgtggtacacatccctgcatgactatgataagctggagctgagaagctacaccctctttcagatgagtcctgtgatactcagggcttcccaatccccaccagccactttattttttacatcacctgcctagaaactatatcaaatgacttctcagtcccttagtctgaatccttcatttttcccatgtaataatttgagttatgaatagaaatagtaatttgcctgaaattgaggaaaatgaaactcccccttactaagccatcatgttatatccccttcttccttattataaaaaaaattatgctgttcagggtggatgcacgtttaagtcaaaatatagaaagtaaacaaaaccattaagttcttaggcacatttgcaaaaatgactcattatataacatgctatgttccaatattaaaaagcagaaatcagttggggatttctgggaaatgtttgctctacttcctctttttattccaactctatttccttctctgtcttcctatataaaacattaagatgaagctgaagcatttatatcatgatgacgaggtaacaattattgggacaaagcacaacataaatatcatagacaggaaagacagaagagtctaaatatcataaggcgttatgttttgttttttgttaaatatgatcctgactgacataatcctgactgatacacatatatatttcacttcccatcacacacacacacgcacatgcacatacacatgcacacacatgcacgtgcgtgcgcgcacacacacacacacacttctttgccctctttgcctcctcctatttattattttattcaacagagagtgactagtgcttactctatgtcaccatattactgcactggccctgcttctacctggcagtgatggagatcagactgtcacatattgcttctaaacttagtaggctcatagaaattaaaaatagcatgttctacctagagctttaaagatcattacagtggggctattagcactgtgaatgggaacacagcctgactctgggtaaaaaaaaagaaattgaagagattatatatgggagattctataattactttaacaaaattaagagataaggcaacaaagatctaatactgtaagtcccacctgcattatttgtgctgaaacaccatgtctgtacattggctgtgacatgtaataccactgaaacacagggtgtttagcaaacatttagttatttccttaagccacctgggctaacaggcaagggattcctacgtagatggctatactgaaagattttgacaccatttaaaaacattcttaggacttttgagtgaattatgttttcagattatttagtttgggcaggttaaacagactgtttttatacaaattctaaaaaagttgacaaccctgagcctcaatttccttctctttaaattgatgattttgatgattctgaattgtaccactattaagttcctgctagatctaccatgtttagaagtctgtaacgtcactctctaacgctgtttatttttttcttctttgcccctgtgtgcacactgctagctcttctattaatctcagcagatgagggaggtaatttcgtttgaggtcaccaaaactgtaggctataaataggaagtaagatagtcattctatagtaaccataaaaatagttctcatcacattgggatgaaacaaaagtcatgtcacctcactctggagacaagagatttatctagttatttgtaattcctatgggctccagatgcatggacagaaagaaggaagatggaaacatggaaggttaaagacacatcagggcctatcctttgcttagtgtgacacaatcaaaggaagaagaccggctccctttgggtttaaccgctttatcaagtgccgctctatacattacccagagaaatgccttctgaattctagaatttcaggcattgcagtaggcagttgaagttgtggcagcagcacataggaagctttttaaacctctccatgcagctctacgatgattatactcattcattagcctttttcaacaaacaatggtttagcagctggtatgtactaaacactctgctaggccttcaaatatggcattgcacaaggcaagatctttgctatgaaaagtgcaaatgtttaaacaataacaaggtagatgttgtattagaaatagtacatggtaaaaaaaaaattaacaaacaaaggactgggtaacatgactgagggtacatcttagtctgtttgtacactacaacaaaatacctgatactgggtaatttatataaaacagaaattaatttttcacagttctgggggctgggaagtccaagatcaaggcactgtcatgtgatctgatgagggctttttttgctgagtcctcacatggtaggaagagaaagggcaactagggcaagcctccctaacactgagtgaagccccttttaaaagggccttaattccattcatgaggcaacagctctcattgcttaagcatttcttaaaggcttcccttcttaatgctaccgcattgaaaacacatgaattttggaggtgatttacgttcatcgtgaattttggagggagcaaacacattcaaaccatagaaggatgtgactaatgcagtaaagattcatatcacttttattctgtgcaaagaaggaaaaacttattttatgttgttactttagtttgcatgtctgagagagggcaagtgatccctcacatctagcttactaagatttattcacttaaggtaccagaagaattctccaccagagcaaaaaaaaaatagtgagaacctaagaattccttcatttagaattaatcctctatatgggaaatatatgtttttaaaaactgaactcatagaagcagagtagaatcgtagttaccagggtctgtttagggtcagggtgggggcattggtgcgatgttggtcaaaggatacaacattatagttaaataggaggagtaagttcaagagatctgttgtacaacatggtgacgatagttcatatcaatgtatgatattcttgaaaatccctaagagagcagattttaagtgttctcaacacaaaaatatatgtgatataatgcatatattaattggctcaatttggcccttccaaaatgaatacgtatttcaaataatcatctcttacccaggtgatgggttcttaggtgcagcaaaccaccatggcacatgtttacccatgtaacaaacctgcaaatcctgcacatgtaccccggaacttaaaaaaaaaaaaaagaaacattaaaaagtagacaatttttgtcaattgaaaaaatttaataaaacttagcctagggtattctaggtaatttacatagattatcccaagggaggaaggataggtagtgtgaacctcttaaagcaaaggtggagtgaagtgagagttcagattagtggcgtggagagtccaacccagttggaaagcaaagcagtaataggagtcatatggaggattctcaatattcacctttgttgccttaacacctagcaggggtagaaggagccaagacttaatagattaatggagtagggacaccaacccagttggaaagcaaagcagtaataaagaccaggtggcaggactggcacaggtgagtactggaaacaaactgagtgagtccacattactttcattatcctctttaaaatgtgtctttccagcatttctgggaagagaaaaacaaaaccagagaaaattcatgcttctagggaaaaggagaggaaatagatagtgcaatagcaagaatgagagtattaatgacaggaagtaatgtaatcctaaagggattagtgaactaatgcttataaatggctcaagtgcctgggccaaatgttctatgtgagaggagctactcttctgttactttctctgagctcattaacaaccaaatggattataatgggcttcaacaggattaagtgacaatcaacaatcaaagtaagacaagagtttattatgaagaatattgtgttcaaagattaacattaaactcgtgaaatatattgtagaaacttcagattacattttgctatgattttctttttatatgtcagtcttcattcctccttcagaatgctctttttatgatgatttgtacataattatttttaggaacccattgatcaatgtcctagtaatatttcattcttttatatcatcttttacaataaaattaagttgctttcagactaatttaaaaataatctttggggttaatgttttgtttccaaattatgaaaaaggaaggaattcaatcaaatattgcattctattaccaagtggattttaagtaccatatgctgtgttttatgccctatattatgtagtcagaatgaaaatgtgctccatgttttcagaatatgtactaccttcatctttcacattatttcaaatagtgagaaaataaatatacatccattcttcctcctactttctttccttatatttatctcccaactagccaccagacattctctctacatttaatacctacaaagagggctggctgctattcaggtcatctggcaagtatcatgttttctccagtatggaaaaactaagacatatgtgttttgtttacagtgtgccaaatgtgccaattcaatgagtttttggatttgttggcaaaaaaaaagagagagactgaaaaatagggaacagcattttttcctgtggccagtggtcatttgttggcacaaggaatttctgtattataaatgacactcaattctctctttgatggcctcactttgagaacagattttgaataaacagatcttaggcacacagaatttcaatcgtcgaggtgtatctgcagaagtaattagatacttgcaagtgacttttaatcacttcaacttgaatccatgtgttgcaaaaagatgtactagctaatgtgattattccaggaacatctaaaagttttcactgagtaacttttttttgacatgacaacttcttatcgtctcgatcttgaagcattggcatccagataaaggcacatgctggcatggggaaagggggggggggataatccacttgacaactggtaaagataatcatatttttataatttttgataaataaattaacttacaagccttattatgactctagtttcttctccctttaatcagttacatctattactgccagagtaattgttctatttcatatattttgtcatataatccacctcctaagaaagactgttattgtttacagattatttctcttcttaggatgacacacaggtcctttcacatgtggtctctacttggtctcccagactcagctagcctccatgagtatttcctagtgtagccatattcaacacactccctgctccctgaggtgcccatgcatttttgcccatggtctttgtcttccagtagcattgaaggagaaagaggaggaggaggagcggaaaaggagtggggagggatgaaaagaggaggcccagagaagaaatgagaggaaagaaatgtccaacgaagggaagagaaagaaaggaagaaagagagtgagagacagaatttctccacatttctcaagactcacctcaagtgatctctcctcttcaagccttccctaaatcccctgacagagagccccatgccaccataccttatgctgtgtcaccctctagcaaatttacatggtataacaaagcatgcttatctttttctccattatagattatcagaaacttgagagaagggtctgagtcttgctgtctctgtgtttcccatcacctagtagtaactagtccaaaactatttttttgaaagaaggaatgaatgaaacctgcaaattaattaaaagcgagagaacaaacaaaataaaatagatttgttcaactctgtttgtataatatgaatagacttctaaattagtctttctagttggtaaattggaggaaaattaatgaacctgaaaaaatgaaaagtaggtgtcacattataagctttctgagaaaatgacttgaaccttttatccttgtgttatcctcctttcccggcgctgaattatcttctaaaatggtttgctcaagtagaaagttaattaatttttattaagcaattagaagaaggaaagcaattttcattttcaagtaaaagaattcgaaagaaacagaggagatgactaatcattaggaatggcttagacgccgaatggtttcccacatataccaagataaaaagaatgcgcaggaggaggatgatccatggagtaatataatactgtcagtcagggtacagacaggaatgtctgccctgtcagctttgatcataccatatggggactggaaaaggaaaagatggtgcttttttacacatattctctagcttccgtttatactgaaaagttattgtaaagagaataagcagatagtttccatggttggacagcctttgtaagttttgcagatttttattgtttttaccaacagtgacatgcttaattcttcaagttgccacactcaactgaattgaattttagtgttctgttaactataaaatataatgattcatttttcaaagtttccctgaagcacatcagttcaatgacatctgtaggttaagaggatgccttatgattcagatatatgagaattcgaattcagactctataattgaccttatctgtgatgttggacaaattaaattttatctttaaagactgtttttctcagatataatatagaggtgaataacaaaaatttaaaaatagctggaatagttggatacatgatatatgccagacattctttcaagtactttatagaaatcaattcatttaattataccaataagtttatggtttaagtacaatgattgcacccattttacagaggacagaagtgagaactagtaaattatgaattatttggtaaatgaagtgtatagcacagtgtcttgtgtacagtaggcagtcactagctggaaacagatattgcttatttcttcatgtattagtctggattctccagagaaagaaaaccaataggatatatatgtgtgtgtgtgtgtgtgtgtgtgtgtgtgtgtattcctttaatatatgtattctctaatacctttatatattatatatataatgtagatagatataggaattagcatatgaagttatagaggcggagaagtttcaggatctgtagttggcaagctggagactcaggagagccgatggtacagttctagtgtgagtctaaagtcctgagaaccaggaaagacaatgatttaagtttatagactgagtgcaaatatgacagcaggggaagactgatgtaccatttcgagaacagttgggcagagaaagcgaatcatctcttattctgcattttgtttgattcaagcctccatggattggatgaggcccactcacactggggagggctgtctgtattactcagtctgttgattcaaatgctagtctcattcagatacaccctgaaagatgcactcagacataatgcttaaccacgtgactggacaccctgtggtccagtcaagctgacatgtaaaactaaccatcacaattcattatggcaatttcaaagaaggaaaacattggcgaaattgtttacaaatgaattctcaaaataaatgttctaattatattttacagagacacagggggaaagcacaaatgatgatggagtctggtttatacttcacacacagaaaacattcattcaatgaataattgagatcatcagttaattagaggtggatatacaaaatttaaaatattgtgacaggtaattgaaaagacaaagtataagaagcattaaaatgagaagacaatttaggaaaagtaaagccggggatatgagggcaaagaatgtaaaatcagacaaatagacaaaacatacattaaaatttgtttaatacaagttaaaaaagaataaaaaattattcttagagtaataaatgatgactgcacagaagaaatatctaacgctagcattttatattttacccaatttcaatccattctcagtagcaccagtagttcacttttaaaacaacaaatctgccatctacattaaaaatgtcttagataatctccgctgtctaaatgaaatcctaattcctttgtactttatttaatgctcctaaaagtttttcttactcttcatttgcagcctcatttctggacacagttttcccaatatacaataaattctatccacaatcaacttctcataattttccggaaacacaatgtgtatgttctttctttctttatatttcttgtcttttctagatgattccattcccctttttccaactagtgaatcctcttccctagaaggcaagttgatgttgatgtgataataaaaggaatgataatgtcatgggaaagaagaggagaatgttggggattatagctctcttttattagttattttggccaatccctgtagaggatatcttaactgagtattttatttaattcttacagcaaacctcctttttgttatccatgttttattgttgtgaatgctatagcttaaagagattaaatgacttatccaaggtcacccagttaataagactattttactcagttcaaataccaaactgactttcctaagaactcttttattaagaataaaaattttaaaattcgtaaagccctacaacgttctttttatattgtatctaattatatcagaaatatttacacatcagtctactcaatttgattttgattttcttgaatctaggaatgagtttcatccaccctgcttcccccatcccctgcagtgttagcttcatcacaagcagtttataatcttttatttaacataaacaaatataaaaaataaattctaagtatacacgagtgaaggcaacatactcaatagtacaaacaagaaatcaaagcgaattgcctttgtcatttaaaaaatttggaggaattaaaccttattaaaattccattaataacgttttctattaataattcccttattaaaatactggaatgtcaatagatacaggtattgaataaaactaagcacataatttaatgatttttcctaattattattcagggaatgtctttgaaaagagaagtgcaaaatatacaaaaacagaaagatcaagaagcatgccaaattggcattgtgattgccaaagcaaacagaacagtctgtaaattattatttagggattggggtggctcttgcatcagtcacaaaaagtgtggaaattaaataatatgctttaagaaatcttgtcataagagaacacagcatacttcttcctacatctatttttaaatgaatttcttatatgattgctcatgaagaggaccaatagtagtctttattgtttataaaccaatcaatatctctcagtctcaatgtgtaacctctctgtcaccattaagacagcagacggcaaaggaggggcaataaattttagcatgtaacagatgaagtagctgatagggtcattagagtaactatcagggatagagaaagctgtctcccaatatcagttcccacaactttgacttttaggttgcatttcttcataaaattcagcctgatttttctaatttccaaaattctacacttattttctattttatcttgtctctttttggatgcttttaaaaattattcctctaagtgtatacttggaaaaaaaattaatgtttctttgcaacttcaccctttgattgttatatatgcattcaactggagatgaagttgggttgaaatctggaattcaagattattttataccaaagtatatattgttttcaggtaatttttataatgtcccaaatacgtaactttttaggctttatttaattatagatatttggccgaataagcacaatcgaaagtttcaattaagagtctaggacacaaagtttggggaaaaaaaatcatagtattctaataatatgtattgctttgatgctgtatgtctaaaagcactcatgaatacctagtgcacatgtgtcaaaataaaacttttttttagagtataacaagttctttagaaaactttttgcatcaaatggtgtaaaaatgaaatcattttatataaatttagaatctgtaaaaggtacaaattatgctttgctcatcaattgtatttatttacatctaatcaaccccatcttctgtttcctactcaatattagctctattatttgattggtttggatatataggggcgtgttatcaaattatacgcacccttgtccttttcctcctttcataagtttccttcaaatttataattcttattacttatttaaatgaataatgatggagaattaataaatagaataaatataaaaagatattaatcatataatcgctcaacacattcctactgaattgattttaatttttgaagaattatcatattatattgaataaagaattagctctcaaataaatacaaataatttcttaggggaaggctgaggaggaagactgaatgagaaggagctttggcaattgggtgttaaataccatgggaaatagtcaaactcatagtagataagaatagaatgaatgatggttgccagggactgcgtgaggagaaaatggaaaattatttttcaatgggtataaagtttctgttatgcataataaataagttctaaatatctgatgtgtaacatagtatctatattaataagacagtattgtgcactttaaaatatgataagagtatacatctcatgttatgttcttaccaaacacacacacacacacacacacacacacacacacacatttattaccttgattttggtgatgatataatgggtatatgcatatttttaaactaatcaaattgtatatatttaatatgtgcagttcatgtgtatcaattatatatcaataaagctaaataatacaatggaaaattcagaataagacagagatggattgtgaaataatgttcatacattgtgttagtttttcttaggctcaaattggtgctaatttttttttattctgagagataaaaagctgaaggtttcagaatatcactaatgttttatatgtagttctgaagatttgtacaaacctctcttccccctttttaactttatataaaaaaggagaaagatcaatctgtcggtatgagaaaggaaaattataagttctatctggggatttactcgtcattaagtttgtatttcaatattgcaaaaaactcttggctatgattagagatattcatattaaaaattcagataatgtagactgttatgaagaagaagtttcaaattagctgaaataagtttcaaagtcagttaatttgttaccagcgggagaaagtcaccattatatttggcgtgtattcctgaagagcatacataagatagacataaacacaactacaatattggaaggtttgcttatttattttatagaaataatcattctgtataaaatttgagaagtgcttctttcttacagtttatcatgaccatttttctattatgatggttgccagggactgcgtgaggagaaaaatggaaaattatttttcaatgggtataaagtttctgttatgcataataaataagttctgaatatctgatgtgtaacatagtatctatattaataagacagtattgtgcactttaaaatcatggtagacatgatttattgtagattatacattttcccatcctaagaaatgcatagtttttgcttccattggcattaaataataattatgtataaggaataaatttaacataaacctcttttatttgcttattcaaatttatttaaaaatttgaatgtttgtacaaacctaaaagtagataaagtgagaagaatagcagccataaattttctcagaaaattacatgaaaacctaattaacagctggtgataacaatggtgaaactaacttcccaagattttaaaatcagtcatttaaaacttacactgtcaaacatcaagttcaatattcattttagtatgcgactctgcaatcgacaaaaatacatttcttttaatttatgaaacagaaaatatggttgttttctctatttcttctcttaagacattatttaatcatctgtatctttcttttattgatctcttccttttaaaatcttcattactcttgtcttttctcccagctagtccacttgctctgctttatcctgttatgatcttcttctaatgctcaaccaccattccaaaagggcttcttcataatttaaattaataatgtgagtgtgtgtagaaaaaaaagcgtagaagttttattttaatgtttttgagcaacctaaatgcgtggaagatgcatcatcacgcaattttaaaaataaaaatgatagattgatatattttaatttgtattacatgctatctgcttatgttcttcacatgttaatggctactgaaaataaaaaccattacaaaattctcttgaagcctttaaacagaagaaacaaccttgtaaaaataaatatttgtctatgtgtctgaagagaaccttcttccacagctgtgtggaagaaccttccacagagcataggtacatgttgcccttttttcaatatttaagatgttatatgtcatatttaaattgttgtagtattccaagacagtaaaactagtgatatatttaatgtgacaataatgtgttaatttttatttcaagacatcttgtatgaactactatttttgggaagaattcacctgccctggattgctatgctctatttggaagtacatatccaaatatcagtcatttatctctattcctaaagtctagtaaatgcaacaagcaatctgaaaaagagaactgcagctgcataaaatgagcataattgattactaattgatatgcatctaatagagacttctttctacccctttagtatctttttatttattttgaataatgttttcatgtttggcccatttccttgttctttctccaccccaatctcccttatttatttaggtcaacttgacaaccccttttttttttgagaatgaattcgatgtcttaaaatctctctctctttttatatttattttagtttggcagcaaacattagttctcgcttgctatattttactcatcaaagtgttaacatcattcataaattattaccaatggtaggcactggttgttatcaatcaccagggaataattgatgctgattgaatcaaataaatgtggtgtttgtgaaactatgaccttgtcattcaacttgggtacaaaaatctattagatctatgagaactgaatcttaaagataactgaagaaggcagctttctattgacttaaacaaataaaaatgtctttttatttgaatatttctttctttacaatacatgatagtctaaagctctgaaaaacaacaataaaatcactactaatctcccttatgtgagactaaatgaagggtcctgggaatattaattctgaaagaaagcttgtccagcctcccattttataataaactatatcaattcaaggactacacagagtaaattttttcaagttgtatagttctctggtttgaaagtgtcccccaaagtttatgtgttggaaacttaatcccgaagcaccagtgttgagaagtgggacctttcagaggcagagccctcatgaatggcaggattaatgccattattattgagtgggttagttatcatgagagcagattcctgataaaacggtaagttcagcctccttccctctctcactcttgtcttctcttgcctttccacctaaagccaggagatgacttagcaagaaggcctgcatcagatgctggcaccatgctctcatacttcccaacctccataaccataagtcaatacatttctgttctttataaattacctagtctcagatattctggtatagcagcacaagtgaactaagacacatagtgagcctttagcagaaccccattttcctaccaacctctcatgtcacctcccacaatgtgcattttcttttatttatactaaaagtgaccaaaaaaaaaagtttagaattgaaactatttccagttggtatcaagatccagatagagttaaccttaatatatatgtgtaaaaagctacaattcaaccgagtctctaaggcttcaaatatgaaaagaaataaaatgtgtttgttgttttgatttagccacaaatcagtgatttaatttagctactcttttccaaatgactatgaatttgatactgagtcagtgctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccaactatggtaattgttgctcctttttttccccctctctgtttcacctgctcaatgtttaacataatcaaggtgaacttttttagagaggcttgcttcatttttcacattgctatgaccattcctacagtcattgtcaaatgcagtcataaatcaaatatctggacataggagtttaggctaagtaagttacaaagttgttttggcgtccaaaacttaattgtataaatatctccaggggatggagatttctcccctgaaaatagagcacttggaacagaaattcagattgcttatttcatataatacaaattccttataaaacaactctttaatctacttaaaatccaatagcccattaaaattatcatcttatcttagaccccattataattcttgtctcattccttcctttcattctctctgtctggcttttttttttttttttttttttttgctaatttttattttcttaattgcattgcatggatgtgtacattttgtttattctgttttgctttgctctgatcatgagggtctttatacttggaaataacaaagtgtaacttaaaaatacaaatatactttttgtgccacatttagagaccaaattcttgattaattattggatcaacatgagttctgggataattcttaaaaacttagtgtgtcatcatgagaaaatcaaggataaccattatcagaagtaaatgtgcaaccagttaaaaattcatatattataggccctaattttatttctctgtccacccaggctggagtgcagtggcgtgatctcggctcactgcaaactctgcctcctgggttcaagtaattctctgcctcagcctcccgagtagctgggattacaggtgcccaccaccccacccagctaattttttgtatttttagtagggaccaggtttcaccatcttggccaggctgatcttgaactcctgaccttgtgatccacccgcctcagcctcccaaagcactgggattacaggcgtgagccaccgcgaccagcctgaaatatattttaatttggttttgcacatcattaaattggtttcccatcatctttgactagcctttctatagttcctgtatttctaagttctcaacatggaaatcaactagttaggatacaggccggtcacctagactaccaatcatctgaacttgatttggaattgatcagtaagaaaaagcaggctccctgcagtgcttctaagttttgttaggtgaatggtcacaggatattttgttttcgctggcatcagttgttgtgagtgaagttcctagcatagaagtggcttttgtagtcctgaagcaggtagacattttctataaaggctctatggagtagaagttattgtttcaacagccagtttcatggtgtggtttcagccaacattcctagaagcttagccctgatctgggttttttagttctcccaataaatttatcagctgcccacacctttcattttttgccttcagttttattgtgctataattgacaattaaaatttcatatatttaagatgtgcaagttaatgatttgatggacattatgaaacactcaattaccacaattaagcttattaacttctatcacctcctgtagttactatcatctatttttgtgtgataagaatagttaagatctatcctcttagcacatttcaagtatataaaacagtatcaactatagtcatagtgttgtgcattaggtctctagaacttacccatctcacagaattaaaattttatgccctctgactgagagcttctcatttccccctcccctcagctccttggcaaccaccattctactttctgcttctatatgtttgatgattttagtctccatatataagtgagatcctagagtatttttctttgtgtgtttggtttattttactaagcttaatgaccttcaggtttatccattttgttgcaaatgaaattatgttcttcttttttaaaaattaacattttgttgcatttataaaccacaccttctttatccatccatccactgcaagacattttagttgtttccatattgtggctacttagtgaataatgctgaaatgaacacagttgtgcatagatctcttaaggaccctgattttgtatcctttgaaaatgtgccaagaatcaaggttgttgtatcataagatagctctatttttatttttgttttttattttttttttttagcaacttctgtattgttttctataatggtcataccaattcacatttctcaaaagaaacatacaaatagcaaacgggtatatgaaaaggagctaaaatgaactaatcatcaggaaaatgcaaatcaaaaccacactgaaatatcacctcatacctgttagcttggtcattatgagaaagaaaaaaggtaagtgttagcaaggatatggagaaaaggaaacccttgtacactgttggtagaaatgtaaattgttacacccagtatcttttttaatacactccctttagctttaattaggtaaaatccaatattgttgcttgtagtcaagaattctggtatggccttcctcaaactgttattcaattaaaggacacccgaagatatatgaacatagaatgatgtatgtaatatatatagaagtcaagaaattctagcttaggtcctggctccaatgtgttcttactgtatttgagcaaatcaattaaattttggcacttcacttttcttgcatgtagaattgttttgagaagagaaatttttattttttattttatctttttttacaatttttgtgggtacatactaggtgtatatatttggggggcacatgagatgttttgatacaagcatgcggtgtgaaataagcacatcatggaaaattgagcatccatcccctcaagcatttatcctttgagttacaaacaatccaattacattatttattttaaaataatgaaaaaaatgcaatgttttaaatttctttttgttcttctcagtattttttaaaattcttgagccaaggatatatatttcatatttaaaagatgacttcttattcttgatgcctatattcttcagcaatgtataataagatcaaatgaaaaccaataattaaatgtcactactgttcttgtgtgcctaatgcatatgcattccattgtttcatggtattcgggtctgttttccttgcacaacttttcattgcgctagtcttgacttttttctgtcaaggaagacatctttaaaaggtacatagacactttataaaaagttgttccttctgggcacttatgtccataggcgaactgcttagcaaaggctcagtggcttgctgtattctggtagaatacagccctgtgcaagaatatagccagagtatagattgacattcggccacctcttattctctaagctgagttgttttgtgtagagaacaaatcacacaatcatatgaagaaggcttcttatatctacatataatacatacaggctgggcgcggtggctcacgcctgtaatcccagcactttgggaggctgaggcaggcggatcacgaggtcgggaggtccagagcagcctgatcaacatggtgaaaacccgtctccactcaaaatacaaaaattagccgggtgtggtggcgtgcacctgcaatcccagctactcgggaggctgaggcaggagaattgcttgaacccgggaggcagaggttgcagtgagccgagatcgtgccattgcactccagcctgtgtgacagagcgagactccatctcaataataataataataataataatattacatacatatatgtatttatctacattcacactttatatcagtgatgatattaaaattagacatttaaattaagtttggtaagtcatttcattttactagaatttaaattactgcctacttcttacaatttaaatatgttaagagactttggaaataattggaattcactaataactttatactgaaaaacattttcaatttgcccaaattgtatactaatgaatataatacataaggtaccaaaaaagtatacttaagaattacaaataattaccaatgttataaaatactatcaaatattgattacaaatttttcaaatttttggttcatcagcagggaaaatttttatcctctggaaaatctaagtatggatatgggttaaggtcctgaattttattattattctcactatcagttgttgtaatatttagaaactataattaacaataatgcttaatgtatatctcccacttttttattgttcctagtactatattgagaaaaaaaaaactaataataaaatgggggcaagtactggggatttctctgtcaagcaaggaaatgcttttctcaagaaaaatctggaagcttgtcagtagaatgtgagaaaggaaagacagttggtatttagctgctgagctcaccacctcctgtgcttattacattcttaattgtttctctcttaccccaactgggttcatgatgcaggaccaaggatgtcaaagtagcactagtattttcagagcagtgcattagggcaacctaatgcctgatctttccatcctaatcttaaaaatgctcaaaccccatgtctaagcttttgctgttcaacacatcgccactagtcacatgtggccattcatatttacattcacattaaataaaattatatattcagtctgtcagttgtactagccatgtctcaagtgctctagtcgcctatggctatggctacgatatagggcagcacacactgaacatttatatcattgagggaagttctattaagagtcctgacctagcacttacttaaatgctaatttgtatttttaacttacagttccctggcatcttgcttgaaatactctggtgacatagtaaaggtctcattcccatactgaatgtgttctttccatttaatagttgccactaggtaattagtagtgtctcatgggatgacagacagcagagcacagcagtcacaatgttaccgtgttttagcctgtaaaccttttgacaaaggcacatgttcctttatcacaacttgtttgtcaaagtagagtaattaacatattgcatccaatctgagataccatcaattgaaagatataccattattttgtattttcatgaacaattaaattaatgacattccgtttggtctacagtctgcccaattccagagatgttaaagtgtgaaaaaagtgtgcaccttaggtttattgaaatttaaaataagaagccaaacttttactcatttccaaaattgaatcttattgcaacatacagaaaatgaagcaacttaaatatagaaaaccttgcttgttagtgtttcaatggattgagaggcttcttaaaatacttctctattcctttattcattttatgtatcttgctatattttaccccactctaactctcttgcttttgggtgttcagttacacatacgttagaatattttatattgctccaaacttttttcctaatacttcttctctttgtattttaatttgagtaatttccactaacctatcttcaagcttaccatttttttaatggtgatatcgaatctactaccaatcagtggcaatttatatttctgttttttattttttccatttccagcatttcttttttttaatttcttttttataaattgtttattttaggtttggggtacatgtacaggtttgttttatgggtaaattgtgtgtcacaggagtttggcatatagattatttcatcacccaggtaataagcatagtacccaacaggtagtttttttagtcctctccctcctcccatcctccaccctcaagtagaccttggtttgttccctttgttgtgtgcatgtgtactcagtgttcagtttccctcataagtgagaacatccagtatttggttttccgtttctacattagttcatttaggattgttttagtccattttcatgctgctatgaagcatatctgagactgggtaacttataaaggaaaggggtttaattgattcacagttatgcatggctggagagttctcaggaaacttacaatcatggtggaaggcaaaagggaagcaggcaccttcttcacagcgctgcaagaaagaaccaacaggggaaaccctcacttgtaaaatcatcagatctcatgagaactcgctcactatcacgagaacatcatggaagaaaaccacccccatgatccaataatctcccaccaggaccctcccttaacacctggggaattgcaattcaagatgagaagtgggtggcaacacaaagccaaacatatcaaaggttatggcctccagctatatccatgatgctgcaaaggacataatctcattctattttatggctgtttagtagtccatggtatgtatgtaccacattttctttgtttagtctcctgatgatgggcatttaggttgattccacgactttgctattgggaatagtgttgtgatgaacagacgtgttcctctgtctttatggttgaacaatttataatcttttgggtatataatgaataatgggattgctgggtcaaatggtagttctttcaggttctttgaaaaatcactaaattgcctcccacagtgtctgaactcaattacattcttaccaacagtgtataagcgttcacttttctctgcaaactcaccagcagcagttattttttgactttttagtaatagccattctgactggtatgagatgactggaagaaggtacctgcttcccttttgcctttcaccatgattgtaagtttcctgagacctctccagccatgcataactgtgaatcaattaaacctctttaccatctcattgttatatttgcttttctctaatgattagtgatgttgagcgtattttcatgtttgttagccatttgtgttttttctttcaaaaagtgtttgttcatgtcctttgcttaatttttaatatggttatttgtttttacttgttgatttgtttaagttccttatagattctggatattagaactttgtcagatgcataaattataaatactttctccagtctgtaggttgtttgtgtgtgaatagtttctttcactgtgcagaaactcttcagtttaattaaatctcacttgtcaattttcatttttgttgcaattgcttttggtattttcatacaatcttttccagtttctatgtccagaatagtatttcctaggttattttccaggatttttatagtttcagggttttcatttaactctttaatccatcttgagttggtttttgtatgtggtaaagaaagggtacagtttcattcttctccaaatgtcttgccacttatcccagcaccatttattaaaaagggagtcctttccccattgcttgtttttgttgactttgtcacaagattatagttgtgcagctttatttttgttttcttttacgtgttccattggtctatgtgtctgtttctgtaccagtcccatgccattttggttactgcagccttacagtgtagtttaaagttgggtaatatgatgcctacagctttgttctttttgctttatttctagcacttttatttccttctttcttatattatattatattcttttatttcattctgctgccatttcccatctaatcatgcatatgtcccaacttgtccactagattctttaacatagtaatcatctatatattaaatttcacaggtgggaattttaatatacagatgattaatatgttaaatatatgtgtcatatataagcttagttctattgttttatcttttgacagtgtattatttattttacttgcatctttgtgtatcttataattttggttagaagccatatatcttcagtacagtagtagaaacttattaaattgtttatatactttatccagaaattaccttttttttggtaagccctttattatagggagttgtgccaatattcaggtgctgagtgctatggtttgaatgttcccgccaacattgatgttgaaatttaattgccattttaacagtgtggagaagtgggacctttaagagatgattaggtcacaagggctccacttttataagtgaattaatgccattattgagaaagtgtgctcttgataaaagcatgaatttggcttcacttttctctctgtcttacatgctcattcaccatgtgatgccttccacaatggaacaaaccccaccagattctggtgtcatgttcttgaatttcccagaccccaggagcatgagccaaataaacttctatttgttataagttatccaggctgtggtaccctattatagcagcagaaaataaattaagacactgagtttctggtttgctgcttctggtcactctcagttcaccacaggcttccaaactctctgatttaccttatgtttaaagggtgggctggtctgtcaggtagtttctctcgatgtctcatccactctcaaattcagatctcccatgtgcacttctgtctcagagaaggtcgttctttccacactcttataattccccctggctgtagactgttttgtattactcaacactttctagcctagtgttggcagaaagggaggatgacatttttcatttttctgttttactatcagccttaggtaggaaagtatgtcatgagttttgagggtagaacccaatatgaaaatcctactgttcttttatcagtataaacttatttaataatctgtgcccagaatgtatttcaggccttcccttaggattttttttcttctatttctcctgagggtagaagtatttgctgctattttgcaagtggtataaagcttttgttctacagtaaatatagaaaaggatctggtttcttagactaggggaatatgtgttattgttactgttattgagtaggacattgtaacaaatgtaatctattgctgatgggaatgctattagcaaaaggtgtacatttggttttggctatcagttgagaagtaatctatagcaaataagtaaataaaagcatgatgttttattgtatttaagtgtttaaggtcaatagcttgatcttcagagataaaactaaaactcactattgaagagcatgaactagacagtcagattagttgtgtactgtagttaatagaaaggataagaatgcaaacgggaaaaattaaagtcaattcttagtcttcctgcgttaatttaaattgtgtttgcaagtgatttaaatactttcccaaaatgtcttaaggaaaacgacttaaatggttcatatagtcagaaagttcccaggtagttctagctcccattgtgacttaataatacatatctttatttatttttcttggtttctttttccatcattttggtcacacttaagacagatattctctgtggtggcaaaattgctccagtaatgtcccacgtctttccagatgaaagtgcagccagaaataatgtttgcttctgttccagatttgttatcaaacattgcatgatgcttattagctctgagtagttacatagccattgtatcagtcattgccaccatagcataatcaagcctctgacatggtatccctggcatctgagaagagccagattccttctaaacacattgacaaagagtgaaagaaaactatattccaaaacaatattagacatttttaggagaaatagaattaactgatgccagttgtctgttttagtcaattgggggtgctataacaaattaccacagatgggtagcttaagtaccagacatttatttctcatagttctgcaggctgggaagtctgaggtcaaggttctggaagatctggtatctggagagggtctgccttttggttttcagatgcagtcttctcattggatcttcacataacagagatcagagaataagcacactttcttgtttctcttataagggcactaatcccatcataagggcttccagctttatgatctaattatctctcaaaggccccatatccaaatatcatcacattggggattagggttttaacatataaatttggatggagaggacacaacattttgtccacagaagtggccaaaaaaacaaaaatgactattgtattcaaagatcattgatagttttcatttacttgatatttcagaaactcattttctcatccttttctagtattcatgtttctctagaattcaaagacatactggtctaatattaaactgtgttcaccatgccaatttaccccagtttttgtaagctttttatcttaggttcagtctaagagtaaaaagcattgtcttttattgtaggttgcaattttgagaggctaagttgtgaaagagcagaaatgtgactacgtttagaatcttcttttgcaactaactttacttttaagctgttttatgctgagatatatacctaccacttaaaatatctcaatcaaagtctacgttaaagctgccattctcaaataaggactatgtattcatttgtcatttaaaatatattctatcatgtaatcctttcagtcaattcatggggaagataatattgtctacttgatgctgacattgctctgatcccaatgataggccaaataaaagttagattaaaaggcatctccctctgacttcaaaatttttgctaattttaatgtaatatgatatgtggatgaacaggcaaaaaattgagtcacatgagttttcatgttttagagaaactattggaaaaaaattgttaagccatgtttgagaaataaagaatattcctggtttctaatattatacaaacctcagttgattattttaaactagtgatgatattcagggcatgtctaaaaaaacactgggagtataactgtgttcatggttgatataattaattttgattcctgttttcattgttcataaaattataattttcaaagtatttgaattctaaatgttctgttttatccagtttttctttttaaattcatataggtttttaactgggtaaatgagtaagaaaaatatatacatttaatatttgagttctggtcttaaaataactataacagttttataaaccaagatgatattttaatttaattatttaaaaaatatattttttggtttgcattgacttactaaatagatttgcagttcagaataaatcataagtaaatgttctaacttgaactaggacttaaataaaaaattaaattaattcaaagttttcattcaaagtctagttttgtgctagttcatttggtagcttttagcctcaaatagctattgagcactggtagcatggctagtgctacattttgaaataacaatattttagatatgttacattaaataaaatatattattaaaataaattacagctgtttattttcagttttaatgtgactgctagaaaatttataactataattgtagcttgcattctattagacagcactgactagatcaatctgcagatctagaaatttagaaagccctttagattttaaatcttctaaaccgatgcctacaaaacaccaatatttaaaatcattttctttctcttagctaaccagcagctttgtgagaatttttattcagcatttctagagaccagcagctttgtgagaatttttattcagcatttctagagaatgctgaagtcactgaatctcaccacttgtgccccatctgtatttatgcaaatggaatagtgtgacaactgatatgtaaaacaatatattttattatgtgcatattctgttattcatagtgtattcaaaaccacttataaggcaaaagaactggtagatgagattgtctaccatcatatactcagtattgacagctgagaacagttttcagtagtagaaatatgtgcattttcttgagcataactagtggaatgttgaaaaagtagtactcattgaggaattatgccctgtatttgaaaatcttttagttattccattatagaccttggtgtgcttttgaggtgctcttgaagtgataaagtctttgttatgttggttggttggctggttggatggttaattaatttggtatcttggtgtcatatttcattagcagacacacttgtacaaaatactctatttttttttcctatgacctaatcaggtcattttgtttgtgcatcaagaggcatgatacccatttcatgtaaatcatttctagatagttagaacataactgtaaaaaatattgaaaatgaaggacaagggcaagaaaaaaatgagctctttaggaattagaacaattattattttcctacagatagcctaagaaaatgatgcacagttaaaagagactaactacaacatttaaaaatttttatcttgtccctgatgctttcgtttccttccttgattgattgtcatcatggcgccccttctttctttctttctttctttctctctctctttctttctttctttctctctttctttctctttctttctttctttctttctttctttctctttctttctctttctctctttctctctctctctctttctttctctttttattgagacaaagtctcactttgtcacccaggctggagtgcagtggcctgatcttggttcactgcaacctccgccacctgggttcaagtgattctcatgcctcagcctcctgagtagctgggactacatgcaagtgccaccacacctggctaagttttttgtatttttagtagagactgggttgcaccacgctggccaggctggtctcaaactcctgacctcaggtgatccgcctgtcttggcctcccaaagtgctgggattacaggtgtaagccactgcgcccgactatcatggcttatattttaaaaagtagttatgcagttatatataacaattaaaaccctcgcctacatagcttaatatgagtctctggaaaattttttcctctactctctctccaaaacagaacaatcattaatgatatagtttgggatttaattgatatcctttgttatactgtatttccaatgcagccaaatgcgattttattattcagctggctatcttttattcaatgtcaggatgagttaatcactttctttctaatagttaccacatatcagtgagttaatgtcatgatgaatatatccagaaaggaataacataggctaaaatagaatattataagaaatattctctatctgcctgtttcacttcaagtattataatattgaatgcaattgctaattaaaagtttagggagtcaagacatgcctaagagtacccagataattgacctagataatcctaataacaagttaggtgccttaaccaagtcattgaaagaatcgtatttcttctgtccagtcgtgtgtcagccactagttgttaaatatctcctgatacatttcttaattcctcactctgtttcctaaactgttcggtatgtaattgttacctggactctaaagtttctttttgtatggactaggtgtgatatttcaaacctgtgctttttactcatattttgggttctgactgtgatatagcactgggaggagattgtaaaacatctgttgagagtcactgccttatctatagtctgaactaaaaatgtctctcttcagatgactccaagagttcatatatttataaattgtatctaatgatttttatgattcggaaaatttgaagaacgtcagagtacactttaaaaatggaggaaagtggccaggcatggtggctgacgcctgtaatcccagcactttgggagaccaaggcgggtggatcacctgaggtcaggagttcgagaccagcctgaccaacaaggagaaactctgtctctacaaacaaaacaaaacaaaacaaaacaaactagctgggcatggtgacgcttgcctgtaatcccagctacttgggaggctaaggcaggagaatcgcttgaacctgggaggcagaggttgcagtgagccgagatcatgccattgcactccagtctgggcaacaagaacaaaactccatctcacaaaaaaataaatgagtaaataaataaataaataaataaataaaggaggaaaggaaaatttggagtcataaaatcagttttctagtgtcaacatggcttttggaatcaagcacaagtgggcacagaaataaagaaaacaggcctacatacttcatgatgtttttttttttttaagatttttttcttatttttcttatttttgctgtaaatcgtatgtactctctccaccttgccggcagttacatgcttgtgacatgtatccttcctaagagggaaaaaatgttaattactgaacctcagattctgatgcctggtctgatttatagtttatgggtgatgtgtttggcattttcaaggctcagttggttttgttgagcttcaggactgaagacttggtcccttaaagaagaacattctgcttttagtaataaccaggttaatgtgggccacatgccagtccagctgaatatgcatgaagtgattgaaattgaaagtcagttccttacatgtttgagtttcatgctatgaggaaccttacaaatagaggtcagagggatttttatgttgaaaatcagtagagtgttacctttgctatggaagaaaacaactttcttccgatattaatgtcagcattagagtaattgctctgtgaaactctgtctctagagttccattctctcttgaacaacaaatctttatcatcaccttagtattcaggtcatttttcataagtagcacataaagaacacattaatctttatagatgtctgcctatatttttatctcaaggttagttattgtcaaatattgtcaacccacagccttttcctttgccaagagttctctattaactcctccaataacctcccatcttttaaaataaaaacattgattttccctcaaagatgttatcattacctggaaactgaggcaaacaaagttaagtcatgtgttcaagttttcagtgtaaatgctgaaccagacacacaatccacacatatattttaatccacaaactcactattaaagttataatgcagactttgacgaatatgacgagcaacatattaattaaaaacctgaacaagtaaataatgttcatgaccaatataaatggatgctttaaaaaaaaatgactcaaacagatgtcatcaagatggcttactagaagcctctagcactcacctcctccacaaagaagaaccataacagcaaaccacacacattgaataggatgtttaagggagaacaatgaaattcagcaaggaagtgatgaagaccatctgaggcatggaagcttgagatggtagcatagagagggaagcaaagaatctggccaagattggctcagagccaagaggtactccccatttctgagaataggtgagtggggaatgccccaaagcccacattttgacaacagatacctgcaattctagctatagtagagcccctcaggcctcataggccctaagttcaccagagggagttgcctggagttcataggattttattatcccagagaaaaaaaattaatgctagatcaccttcactcgttgggacccaggttattgcagcacaatgacattttgagagcatggtcaccatcagagtacatccttccctgaggacgaatagcccctgcatttccacatccctggggcctgacatccatcccacatccattcagagggttgcagtgttgcgccaccagctggacccaatagttcagctgtgactgttgtactgaagcacatgcaggaccctccatcctagagtataaatagtctagcacagtgaggaagctttcccccggacggagaaagctgacatgcatattccccagagccttcaagccaccagttcaaggcataacaccacaaccagcaattacatttactccagcagcagagatgccatgaacttgtgcatttacttgaagggtctgaaggctggtctgcctggtatccccacctctgagcaaacttgtgccatggcaaataatcacagaatggccacaaaggcacttagagacactgctgacattgattaccaaataatttttatagagactatattactgtgcccactcagaaccaaagccaaagtattttatccaagtaaaactgtaggacacacatagagaaaaagatctttccctataaaagctacttcataaaactggaagaagagattgttccaccagatgcacagatattaacataggaataccaaaaaaaatatgatttagaaattcaataaaaagatagctgtattaaaaaagaaccaaacagacatattaaaattgaaaaattaaataaatacaataaaaataagtgcttcatcaatagactaaattaagtagaagaaagaatttctgaacttacagacaggccttttgagataaatgcattagccaaaagaggaaaaagaataaaaatgaatgaagcaggactacgggacgtataagaggacattaagaaaacaaatattggaatcatggaagttccacattaagcagagaagaagaaaaacatagaaaacctgtttaatgatgtaatagctgaaaactcaattcttggaagatgtgtggcatgcagataacaagctcaaatatttccatgtagatttaacccaaaaatgtcctctctgaagtacaataaataactatcacaagataaagagagacttctaaaaacagcaagaggaaagcatcaagacacctatgaggaaatgtcaatcagagaaacggtaaatttgttagtggaaactatacagatcaggaaataatatgataatatagtcaaaattcagggaaaaacagacaaattaccttccagccagaaatataacactcaggcaaaactatcctttagaaattaaggagaaataaagtgtttcccaggcaagcaaaaattgagggaattcatcaccactagactggtcctacaagaatgcttaagaaagtcttacatttgaaagcacatgggcaatctctaccattataaaaacatataaaaatgtgaacctcactggtagaacagataaataaatgagaaataaaacagaatcaagttaaatcaatatagaaaatcaacaaactgcaaagataagcaataagagaggaagaaagaaacaaagaatttgtaaaacactagaaaacaatgtaaaaaatgataggagtaagtttttcccagtcaataactgactagcatgtaaatgatttaaattccccaataaaaagatacagaatggctgaatcgattaaaaaacaagactcaactatatgctgcccacaagagactcacttcatttgtaaggatacatgtagactgaaagtgaagagatggaaaaagatatttcatacaaatggaaataaaaagtgagcaggaaagctatatttatatcagataaaatagactttaagtaacaaaaaaagaaacaaagaaggttattgtgtaataataacaagatcaattaagcaagaggatataacaatgttaaatatgtatgtacccaataccatagcatccagatttacaaagcaaatattgttagaactaaggggagagagagtctccactacagtaaaagctggggactttaacgcctgactctaagcatgaaacatatcatctagacagagagtcaagaaacataggtcttaaactgcacttaacaccaaatagacctaaaaggcatttataagtcattttatcctttagctgcagaagacacattcttctcattagcacataaaatattatttagcattaattatacttagagccaaaaacaagtctcaatatatttttgaaaactcaaaattatatcaagtaagaggaagcagagcataaaactttagaaaattttcagtctgatgatgcaatagaaaagaaaaacccattttctgaagagaaattcaagccagctgcagaaatttgcataagtaatggggagccaaatgttaatcaccaaggcaatggggaaaatgtctttaggcatgtcagagcccttcacggcatccccgcctgtcacaggcctggaggcttaggaggaaaaaatggtttcatgggccaggcccggggcccccctgctgtgtgcagccttgggacttggtgccctactttccagctgctcctgccatgctaaaaggggccgcggcacagctctggccattgcttcaggtgcaagcacccagtcttggcagcttgccttgcacatgatgttagtcctgcaggtgttcataagataagaattgaggtttgggaacctctgcctagatttcagaggatgtatgggaacacctggatgtccagcagaagtctactgcaggggtgcagtcctcatggagaacctctactagggcaatgcagaaggaaaatgtagggttggagccctacacagagtccccactagggcattgcccagtggagctgtgagaagagggccactgtcctccagaccccagaatgttacatccactgacagcttgcaccgtgcacctggaaaagctgcaggcactcaacaccagcccatgaaagcatctgactgggggctctactctaaagccacagtgggtggagatgcccaaggttgtgggagcccacctcttgcatcagcatgccctgaatgtgggccatggagtcaaaacagatcattttggaactttaaggtttaatgaatgccctcttggattttggacttgcatggggcctggagcccctttgttctggccagtttctcccatttgaaatagttgtatttacccagtgcctatacccccattatatctaggaagtaactaatttgcttttgattttacaggcttataggcaaaagggacttgccttgtctcagatgagactttggactatggaattttgagttaatgctggaatgagttaagactttggaggattgttggaagggcatgattgtgttttaaaatgtgaggacatgagatgtggggggggtgcatgggtggaatgatatgatttggctgtgtcccccacccaaatcttgtcttgaattgtagttcccataatccctacatgtcataggagggacctgatgggaggtaattgaatcatgggagcagttaccttcatgctgttctcatgatagtaagttctcaggagatctgatggttttatagatggtttcaccccctttgctcagcactcttctctctttctgacttgtgaaggacatgtttgcttccctttccaccatgtttgtaagtttcctgaggccttcccagccatttggaactgtgagtcaattaaacctcttttctttgtaaattaccaagtctcagatatttcttcatagaagtgtgagaatgaatagtatggaatcattgtaagtgtccatcaccagctgaatgaattaaaaaattgtggtataaatatacaagggaataatatgcagctattacaaaataataaaattctgttatttgcatcaacatggataaacctggaagacattatattaagtgaaataaattaggcacaaaaagataaataccatgtgtatcacttgtacgtgggaacaaaaacatttagctcacagaagtaaagagaagaactgtggttattagaggcttgaaaatgtaggagtaagagaagatagaaagaggtttcataaaggatataaaattatagctagaaaaaagaaggagtcctagaattctatactacctcgggcaactatagttaacaataatttaatatatattttcaaaaatcctaaagagaggattttgaatggtcacaacacaaagaaataataaatgttttaggtgatgagtatgctaattacacagatttaatcattacatattatatacatgtataaaaatatcacattgtattccccaaaatatgtacaattttatgtcactcaaaaattttaaaattttctaaatgacaagaatattttaaagatctctaagtaaaaagttttaaaacatttttaaataaaatttttattcaacaatatttaatatgcttctcagtttaactagaatttaataagaataagatgttttaagtagtcaatatttagagtgtgtatatgtaaccaaaatatgaaaatgtattagtattctttacaattaaatgtgttttaaaggtgcaatataatccttgtaaggaaaaggcaaacaaataaataagtccacaattgaccagtaaaagacaaattatgtatagaatgtaagtataacattcaaataaagaaaaatgacaaattacagaacaaattgcattgagcaactttctggttacttggggaataaaaaacaaaagtggatgtatacctcacaccgtaaataaaaaataattattgcttaatgaagagatcataaattttaaaagtactagaagaaaaaagtgtgtgagaacttacaatgttaagctagttaagctacttttggcatgctacttaagtatgagaccataaaggaactaacttttagagtaaacatataaagttttaaaaattatctgtggaaaacacacaaaatgaaaacacagatgctaaatagggtaaaatgtttactacatacataaaaacaaagttataatctgtcatataaaaagagcttttagagatcaataagaaaaagatgaatgaattcccaagaacaaacaggaaaaagacactgatatataagttatgaatgaagaaacacaagtgattacagcttatgacaggatattcaagctcaatcataaactacaggtctaaatgatttgttgttgttgttgctgctgtcattgtcattgtttttccttgaaataatttaaattacctcaatggcaacatgattttattgtgactttgaacaaagagagagatgcttgtgtagcatgtaggactataaattgttttagccgtagtaaaaaatgactggtaataggaatcaaaatgtaaaatgtgcatatcttctgatctacacattttacttttgagaatatatcctaagcgtatgcaaaatatgtaataaaaataattttagagttttttatggtatatggaaaatatgaacaatctaaatagctattaataggtaaatacatatattataatacttggaatttatatttattaccatttttctaatatttaaaaaatcatttaacacaggtatgttaattatgtatgagggtatagtgttatgcaaagttacaaatacaaaatcaatacaactcattttaaggattttctatctctgcttggtagtaaaacttttatggaataagttaacaagttgcaattgaaatagatttgagcttttctggttgtaatctcttgggcttagcctcaggtaataaccaaaaaatttccatatatttttgtcctttaatcctcataataaaacatttggatatatattattttctctattcccttgatgagtgaattgtggtttttttcccctttctttcttttccttccttcctgccttcctaccttccttcctttccttccttcctttcttcctttctctctctctctctttctctttctccttctctctctttctttctttctttctcttccttccttccttccttccttccttctttcttcctctttctttctttttcttttttcttgtaaactgctaaggaaaacacaagctaagatttgatcctattgaaatgaagacaaccttttctccaaagctgcttggaaatgaaatgaccacttttcgaagtcatggtttattcagttaacaagggcttgtaatttcctatgtgttgaaacaataattttcatccttacaattctagttccagcactaaatggaagctaggttgggagtttggctctctgtcctattgcaatatatttatttctgcatggatatgctagagagaaaactagtttatagctagtgagacaatgtttaaacttatttcgctataaatgaaaaatcgcttgtactactttcagtaattgattttaaatgccattcaggttatcaaaccagatattttcaaatgatgataagtagaaaatagtttaatgccaactgatgtggaagttgcttatttgtgttaattaatgaggagaggtctggtccatgaaaatattgtattacaaacagtggcattgtcaatgaggctgttagtttactcaagagtgtagtatggtgaaagttacatgttaaatatcaattactgaaaaatggaacatctttgaaaaggaattttgcactatagaaaacgtcgcaggaactctaagagcaattctaagagcaatttaaagaaggtttttctataatataataagcttatttatataacagggaatatatcagaaaatgatttattctgcctgctcaaagatctcctttggggtaataaagtataatcttctggtattagctgctattaatacataggccagttgaattatatcctaggcagaatagccctacatgcaattgaaaaatgttgtccaggtgatttttggtatgcttttaatatttgagtcatcagccatccattgtctaaagtaaaataaatatatcaaataaaaacgtgtacttcattcatctcattaggttgtcagcatttacagttagagagtatttctgaaagtattgtatttcagttcagaggaaatacactataaattataaaattgctgacacagtatctaattcttttccactgtgatgcctactagacccaaataaaccaaagaaaagtataaatagtactttattatacatcttgtgtggggaccgcatcatgctgcctataacagaatgaccaaattggttttgtgacggtcagttttgttttgctttttaattagcaagtttatttttatgttttatagattttgtcgtaaatacagcctaattaacacctataaactgtgacatatctagactatgcaatattgtttactgaaaaagagatgaactatcaaggcatgaaaacacatggatgaaatgtatgtgcatattagtaagtgaaaaaagccaatttgaaaagtctgcatactggatgattccaactatatggcattctgggaaatgcaaaattgtggagacagtaaaaaaatttagcatttgctcgggattaggatggaagaagggatgaactcgtggaacacacagaattttggggggcaatgaaactatgctgtgtgataccgtaatcatgaagatgaatcattatatactcatcataactcacggaatatacaacatcaagagtaaaccctagtgtaaattatggactctgggtgacaatggcgtgttgatatacgtttattgattgtaacatgagtaccactctggtaggggatattgatagtggagaggctgtgtgtgtgtggaggcagaggtatgtgagtactctctgtaacttccactctattttgctgtgaacctaaaagtgctctaaatgtgtctatttttaaaacataaaataaaaataaaaaacctgaattttatattcgtaatcttcatacttttagtctcaccaccttaagtattttactgtttgccacttaccaaaatggtggtgcaattgaagaatggtacgtgattcctctatgttgtatcatagtaaagtcatgcttgcatttttttctttcttattgtagtagaaaagccatggatttcagaatctgtaagatcttagttccaattctagttatactagctgtgtataaacttatttcggtataaataaaaaatcgcttgtactactgtcagtaattgattttaaatgccatccaaacctgaaggatagaaaatatccttttaaggttataaatctatccaaacctgaaggatagataatatccttttaaggttatagtgaacattaagtaagaaatattttgaagtagtttaaaatactaataaatattaagtatacttttaatactcatatatattttccttttcaatcaatacttgtttttcgatgttcacaaagcttttgttaaaagggcaatgttttaaaaatatttctgtagagctgtagtttatcattgtgtgaatcatattacaacactagagtctcctagctcatagctaggagctagttagttcgtaactgtgtgaagaagataaatcttttgaaacgacaaagtcacgactcactcatcttaaaaggtatctcattatcctagaacaaacttggcatcattgtattactgacttccaagagaaaccaatcccattttgcctgtattgtctttcctcttaccggcattttttaataaatgctgttgacacagtagcttgctttctcacagttcagttttcctaactgtttgattccatggcaaatccataatcctattttaaatattctccaggccatgaaaatgaatgctatttatatcaattcggctgttcaactgcagtgcagaaaaagcttttgtatccagagatacaagcctctggttcaagcataaattactgggatacactgctcttttttcttttaagctgaactctccttgacacgaatccccataggtgtcttaggtaataactgatattccaagaaaaaaaattgtgaaaaacagttaaaggaaaagacaatttacatttttaatctgatagatcatgtttccaaaatgaaatctctcttaactctggtaatcaattaattcatacatatttccatcaatagatctttgaatagtggcttaattggtcttttggaaatgaatcatttgcaaaggtagagtcgtgcttcatgtactagctccctgaaaggtagtgtgcagaaagattaaatcgcaaagtggattgtaatcaggcagatcttggttcagattgtgactgtttcctacttaaactttcagttttaaaattgaacttggcagagcttattttatgaagtatgaataatatttacttcttgagtaaataaatcttgaggttgatttaaatgttaagtaatataatatatgtaaagcactatgcagaatctggtatgtagtgaaagctaaatttgagttattattatatgcaggactatcttaagtttgacacactagctgtatttttctaaactgtataaatcacttcgactaagtcaactagtatatttctatgacgtactcataaaaccaaaaagattaatcatttcttggaaagcttatgaacttataatatgcagtcctaattgaaccatgacctacaacagagttttccataccaatgtaatgtttcttggccttgttgcaccgaatggaacataagctccgtggggacagagattacatttattttggtctttgtattttgcaagttacctcatttatgaacttgcacataattagtattcaatagttacataattagtattcaatagtcatttataaactgacaacatataaaagtaaatacaggttatcaactgacactcttatttatcttattttaaaaaactttattatgataatctttttaaaaatagttattgtggtgcctgtatcaaagatattaacagaaatttgttaaataaatgaatgtagttaattttcatttacagagcatgaatgccagaatttggataacttctgtactttccttgtgttcaaattctggcaggactaaaatatgtctgtttttcctttcttccaataatatctcatgccatgtttatataattaatacagtagattattatccataaattacatatatgcaaattcaactacatgctaaagttaacttgtgccccacaaatctactcctgggtctttcacagtcattcatagacatatgcagaataacagaacaattgagttgcttgttgtctactttcccagctaaggttgaacgaggtgacactgtgccttcctgtttcagctcttttactgtaaacaattatcgttttgagggtctacttagtgacatgtttttcacatttttgtgctttctgttggtcatgttcctgtttaaaatcacttcccaccagtcacttctgcccccaagcatagtgatgaagagttgtcctgtcttccttagtgcaagaatgctgtgatgtgccttatggagcaaacacatgtgttagataagcctcattcaagcgtgagttatagtgttgttggctatgagttcaatgttaatgaatcatttaaaataaggtgtctttaaacagaaacaaatatgaagtaggttataggttaaagggttcatgaaaatgttgtgaccagaggctcacaggaacctgatcctgtatttctcctaggagcaatgattcagtagttgctaattcagtgtttatgctgagaatacaggtaaaaacaactgcaaacaatgaaaattgtctataccacttgtagtagtcaactcttagtaatcaaactcttcttagggttcacagtataatatagagatgatgggtaccagattggattacatgatcttttgatgttttctgagtctcctaatacttttcttgatgggattgaatgattggatatcttaaggccagcttccagaaataagctgatcaagttttgatatggtatattggaattctgtccactcccactgccttttccataactattcacactctaataagtagtggaacatcatttgcagagatgggatgaataggtaatttttggctatgaaatttgcttgtccccataggtctctcagatgctcagtttggctttcactgtgcagcagccaatcattacaggaaaaactgttactcttcctaatcttaagtaactttgattttaccctctcgtcatgaaataagacctacttagccgtatggaaggggagtttaagataaaggaaattgaggaatgttaaaaaagagtagaaatgttatccaaggaaggagagagaaagagatgcagattagcacagggtgaatttagaccagaatgccttaatacagatgttcagtaaagctaaatctaattctcattgaaaatcccccctccctttaaaatatctccaacactatgtcaagaaagagagaaagagagatagaaatttcttcttccaaccttgttcaagattttgccctcccccatattctttattctgttgtgggcaaggaatgtgatttttcttattgaaagttaaaaaacaggaagtatttgagatctgctgggaacacacacacatgcataaaaagatagtgaatttggaggaaagtgttctaaactcagagtaaagggctaggttctaattatctgcagatggcaaattgctggctttgtaggatggatggatggatagatagatagatagatagatagatagatagatagatagatatggatgaggcccaagcctatatgttactgcattctgctgtgggtttgcagacaagtctagtttaacttctttattgcagtcttcacctcaacacacttactgcaagagacaatattgttatcaggctaagaactacagaacagaaggtggatttatatattcccttctccaatcacaccatttgaagacatataagtcctctggatttacaattagagaacgaccagcaacctctataaaaaatagtgcagaaagagaccaagattcaataattatacacagttgttaggtctcagtgtctgctttgcctaaaatgataatgcccagcaactttttctctttagatgtgtgcctaaaagccaggtacagtgtggtaggtgactcaaagataggatgaataccctctttccccccacgatatcatgacatatttgtcttctttgaagaccaagaactcacttggcagtttgctttggcagcagagctttctgagagagagagaaaaagagagagagagagagagagaaaatattgacagaagtggtcacatttctcatctttttgtcagctctggtagtaaattcaagatttaaatttgtagtaagtatggaactttatagaacacaaagtaaatgtcaaagtagacaccaggaaaaattatttttgcttctacagccctatcacaaaggcaatctcagatttaatagttattccaaaaggagcgggagcataaagcttcattgtaaaacacaatactctaacaaatggtggaaggcttgcaatttcattgcaaagagagaacatagcacttctttgccaaatatgtggcaaatcatatttaattgaagctattattccagtgagaagaaataacaatttgacttctagggagttttaattgacagtattataatatttgtgcaatgtacatccactacaagaataaaagaagcttttacaattgcatactgaaaaatgaaagtatcaataaaatttctgtaaatcctggaaataataatatcacaatatagctagctaaagaacaattttcttcactagattcacatagcttagagaaaaataattttcacagaaatatactcatcatctctttccctaacccatcttttgtaattttcctaatttcctctgtattccactatttcatcatctcattattaagaagcaaaacatagaggcatttttgcattatgcactacagtcttttgtttgaaatttaatgggtcatgagttctgcagtccttgggaagatagtctttaaaaaaatggggatttttagatattacatacttgtagccatctgcttaatatgtcattttcaaccattactatgaaggtgtggagagtgttatctcacttcaacttcaccaacaaacacttcaacatgcattagtttttttcctatcagaaccatcactcaagaaataccagttgaatgcatataaacatggcactgtgctaggtaatgtggaggatgcaaaggtaatagacacctgtatctgacaacattctagtaggaaaaggagacttacacaaaatgtttatatagtttcactacagagtgagatgtgtcctaagagtcatgcaggaaactgtgcgagatggatttcagtagaagaaatcaatatgagctccatacgggggctttattataaggggtagaattctcacctcagttaaggtagaatgtccttgggggaaaagcaaaaaaagttcaggacacacagggagaatccatctaatttgaagtatagacgatgtaaagagagggagtgggtgataagtttagaaaaacatgtaaaagccaaaataacaaaattatttaacatcagatgaggcagtttgaactttattttacaggcaatagggcattagtgaaaattttgaacaagaaagtaacataatcacaattatactcaggatagagtggattaaataagcaatggaattgatattagaaagaaaaattaggcataaggcacagagagggtgataaacttctgagctagaatgttttatattttcatttctgcctaacaccaattcttggattacctggatgttactaagaatatatatacatatattcacattaagataaagctatgatcaataatgtttcttttttaatttcagatttttcattattcgtatactgcttcatatgtgatttacaacatacacactaggtaagttctttgattttctagttttcatgagcaattgtgttactaaattgttggtgtagatatcagtttgttcatgtaaaaatattcacattttttcaagggaagtttgggagttaaatcctccagaagtagaggactccgtcttgcagtacgcggcctggggtgtccaagggcagcagctggtaagcgcaggcattggtatgcactgaacactgccaatcatggttttatggaagatgttaactgaaactttggaaaaaccataggaaaacttgtcctacaaaactttatgtttccctaagtcctttatatcttttatctaatagtccaacttaagaatacattaaatgatactagtattattttatcagttaataaagacaaaagtttattaagtaatatatgattaaactgctggtttataatgaaacctagaagagattcaaggttactaggaccttgtactgcatactttccattacataatattgtcagttttcatgaaaaattcaaaataaagattattttttcttaaagcattgttcagggtaaaaatttagacagaattatttaatattctcttaagagaggatttttacttttatttttattttgaaattattacaaactcaaaaagataattattgatatataaagcagtttgagcaattatatatatatgtatgtgcatgtttattttaggcaaagtcttgctctgtcatccaggctggagtgagatctcagctcgctgcaacctctgcctcccaggtttaagcaattcttgtgcttcagcctcctgagtacttgggattacaggcacatgctaccaggtctggctagcttttatatttttagtagagacggggttttaccatgttggccaggctgatctcaaactcctgacctcaagcgatccacccacctaggcctacccaaagtgatgggattacagacatgagccagtgagccccgcctgcaatattatattcttgtacatatctcatggtgacaatgtaaagcctttctcaagggaatattgctcagggagtagtattgcttactatcctgtgcatgctcagatgtactgagcatcaccaaactgatttctaggttatttgttaagcgtgtttacacctaccagcaataatgagagcgttcccttggttccatatccttgccaacacctgtttttccagacttttaaataattactcaaatgatgatacaaaatagtatttcgttatagttttattaacatttagtatttccttgaattctaataagctagagcaacttttcatatggttactggcaatttgtattttttcatatgtgaaatatctattcatatatttgtccattcacattttttattcttttttttttagttaaaaggaaccccttatatgttctggatattaatacattgtttggtctatcttcatccagttttcggatttacttctcactctcttaatggatccatttctacaaacatatttttttataaatgtagtctgatttatcaaatacatgatttgtactttttgttattgatgaaatctttacaatgaaatcatacttctctagaatttttcaagtgggccttccatgtataggttcttgatccatccatctgaaattgctttttttggtatggtattaagtccctatccatttttatatatgttttatatggccaacaattgtcctgaaaccttttgttgaccacttcattctttaactattcatctgcagtgttacagtgttatgctgtacatatccatgagtcttcttccggctctttttttcttccaggtggtttgtctattagtgtgctaagacaacagtatcttaattaaaataagctttactagctgacaaggcagtttcatatgctgactttgactcttcttgactttttagcctttcatatgaatgtcacaattgtctttcatgttacatgcccattttcagaattttgaatttattatttgaatctatatgtctattttgggaaattaacatcttagtgatactgaatcttcatatctacaaacatttaatgtatgtatttagttatttaagactcttaatatctcaaattttacaattttatatctaaaaatttacactttatcattttggtgactcttttaagtgcttgcatttcttattttaaaaatgtttgctactggtaaatagaaaggtactcaaattatttatttaatatatatcaaccttgctacgcacaattatatattccaaataattctgtgtagactattatgctttttgttaataatgacatttttcttttccatttcaatttttataatttctatgtcgttaaaatccttctgcactagttaacctatgaatgtaactaggtatggtggggttttttgttttttgtttttgctggaatactaaaaaattgattctattatggttactgggttaagttttacaattttttttttagttagttttagttagtgactgcaattgatgagacatgctttatggcttgggattttttcaaaatgctttttatgtgatggataattttatatatgttctatatgacaggaacaatgttctatatgtgcctacaggatcaatcttaataattatgtttctaagagttatattttcttactaatgacagtggatatgtgatttttttctttagttgtcagttttgcattatataatttgaactatgttgtaaagaatgaggaagttataaaatgataaatacatctttctattgaattcaaatgttttataccttaataaatatatttaccttatttacctttaataactctgattggccaaccctcatcctatcctttaactagttcttttaacgtagtttagaatcctctaggcttttttaaaatttgaattgctgttttaacaacagctggttgggctgagttaagtttttaatttcctgcaagcctcaattttctcatctataaatagaaatatgtacaccatcatatcattgtgataattattttggaaaatgactatttttcataataagatgcacattactatgatttatatcctattttataaatctgtatatttcttaagcttattagtgaaatagggtaattataatagatatttcatatcatgagaagcctacagaataatacactgtggctaaataaggtttcctttcattggaaaataatctggaccctcaaatattcaaagaaatcctacaaacaaccctgcattcactgtcctttccacactaaatggttgaataattgagtaaatcattatgatgaaaaaaggttagtgatttaaaatgaaaaatgtctgcaattgtccagataccacagattatagacattatatttgcttttatcttgtagatatttagataaattaacaaacaatgcatttaatctaccatcacagaactctctgtaatctatcccactatgatatttctgaaaagtggcagcaaaatttgcatagaatatggtaaatatgaatgtgcagggtttggtctagataaggcatgtaatcaatgaaacattcatggacaatggtgagtggacaccaagaagtggcaggtgctctcatccttcctgtttcactctgatgttgtgaacaatagagctggtccattgggccagaagcaactttggaacaaaccaaattccagaacacagaaacccaagacaactccaccttttgtacaaaatactgcccagtattttagaaaaaaatggacagtattttggaaaatcttttacactttggttggttttaaatgaccctcttattcttcatacttgagggaaaccaacacctatgacaaaataatagcactttgatacactcagggaaatagtattaatgtatgcattttctttatttgttattgattccttattttttaatatatttaagaaaattatgaaaatactaaaaatgtataaaaattataggttccctgtttgaagccatattgcaggtgattacattctggttctactgcttactagctgttgatcttgagaacattatttaatcttgatatggcttactgtttccatctttaaaatggtagtgctttatcaatagtgctattctggtgtttaatgtatgaaatacagttctaaagcactttgaatagtatctggcctataataagtattttgtaggtattcacttttactattattaaaaaatctgttttcatatgaatttaaacaccttagggaactttagggtgactagttttgtggagaattaagcttaagttttctgtaatgtcatttttcaaactcctttggggaattcttaagagaaatttcatatttatctagtttatcttttgagtgcatgcaaacataaatttaaaaaagtaaaagacatacttctacaaatggccaatggtccatttcatatgagtttggcatgctttgtcaatatttgaagctattagcaaactcagcaatatgattttattagagatgagtcattacaatactttaattagttttgcattaaataaagaggcttgtagtgtttactaactaaggataattaattatccttcattttcagcttctaatcttatttgctgtaaaagaaattcctggtattatagaagagaggcaagggattgacataatttactgaggaagaggatctaagttagaactcagaatattgaggagaactttcaatagcactaagtgtgagtaaaggcaatttagatgtgtcaaaatttgtggaaaaatgaacctgaagcaataaagagtgcattatttggagaaggtggtgagtgaaccactttagctgtaataaagttttattgaatagaaatggtttgggaagaggaatctgggaattatggtagaaagagaagcaccaggaatctgtttttccattcagataacaattgctacagtagacatgtaactattgagaactctagtctattgaaagtgtgtaaattttatgggaaggcttgaatggaagtttgtggttaattttagttgacttgaactcttagctcagaagcagctacctatcttcgaccccagccccatggcaggcagctgtgcttatgttcctggagcatgcattcatcttgcaggaaccaggatggacaatgagggccctgtgatgcaaataagtaaggatttgtattcttattgtttattgccccttctcattatgaaattgcagatatagaggaaggcagctattgtttcacatccttacacccttataacaagctcctctccctccagctgaagtgaattctaaggtggttaaaaggccagtgccctttcctactcttcatttttctcttttttgagggatgtcagccattaaaaattaagatattcaaaggcaactgaatgtatgggagaaattagcaagtcaccatacatgcacagggaaagatgcaggcttacaaaagatctgagaagacttttttcacataaggctgattctcagcataaagacagcctccaacaattacaaaagaaccaacataacaaaacaaaagcaaaaacataaaatagaaaaccatgggaaatgggaatgtattagtccgttctcatgcagctaataaagacatgcctgagactgggtaatttataaaggaaataggtttaatggactcacagttccacatggctggggaggcctcaaaatcatggtgggaggcaaaggaagagcaaagtcacgtcttacatggcagtgggcaggagggcatgtgcaagagaactcccctttataaaaccatcagatctcatgagacttattcactatcatgagaacagcttgagaaaaacctgcccccatgattcaattacctcccaccaagtccctaccatgacatgtgggaattattaaaattcaaggtgcaatttcagtggggacacagagccagattatatcaggggagattctgatttccagagataccaaaattattagattcaaattgtctggttttcaacaataaaaaaattacaaagaatacaaagcaataaggaagtatggcccactcaaagggataaaagacccaacatcaagaaataatggaagtcatggaaaatatgaagaacatgatgtatgaacaaaatggaaataccagtggagagagagagagtaaacctaaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggagaaattaagacattctcagataaagaaaaattgacaagagttaccactagacctgccctgcaagaattactagtgggagtccagcaggttgaaatgaaagtacactaggcagtgatttgaagccttataaagaaataaagatcccggtaaatgtaaatacatgggcaattatagaaatgtatgttattgttacaatgatttgtaactgcactttttcttttctacttaatttaaaaagctaagatatttaaaatttttagtctaaaagctaatattattttaactttaatttgtatttcacattttttttagacataatttaagaaagtaatgccttaaatgtcattagttaatacctttggatgtacaatatacaaatatgtaattttgtgacttcaataattgagggaggtgaggatgaaactatgaatgagcaacgtttttgaatgttattgaggttaagcttgtataaattcaaatcagcactataactttatgatgttgcatggaaccgccatggtaacaacaaagaaaataataaatatacacaaaagaaaggaaatgagaatggaattaaaacattctactattaaaaattaaactcaaataagacagtaatgtggaaaatgagggtaacaaaagataagggatatagaaaagaaatagaaaaatcacaaaagtaagttattccttatcagtaattactttaaatataaatagattaaattattcaattaaaagaaactaagaagataagttttaaaatataatatgattcaactacatacgctctataagaaactcactgtagatacaaagacacaaataagctgaaaataaaagaatggaaagagatatttcatgcaaacagtaagcaaaataaaataggggttgctatactaacgtaaaaataggcgttaaatcataaacagttttgagagacaaataaatcaatacagtaagaagatataacatttcaaacatttatatacctaataacagaccatcaaaatatataaagctaaaaatgaatataattgaagggaatatatatatatatatatttctaccataattgttggtgatttcaacaccatactctcaataatggctagaaaaaccagagagaagataattaagaaaatagaggatttaaaaaacacagtaaggccaggtgcagtggctgacgcctgtaatcccagcactttaggaggctgaggcgggcggatcacgaggtcgggagatcgagaccatcctggctaacacggtgaaaccccgcctccactaaaaatacaaaaaattagccgggcgtggtggcgggcgcctgtagtcccagttactctgaaggctgaggcagaatggcatgaacccgggaggcagagcttgcagtgagccgagatgtgccactgcactccagcttgggcgagagagcgagactccatcttaaaacaaataaataaacaaataaaaaacacaataagccaactagacttagcagatgtatacagaacactcaacctaacaacagcgtacacgttctttcacgggcgtttgagaaattcttcaggatggatcatacattttgccacctattaagtctcaatagcttttaaaaaattatcacacaaaagatcttctctgatcacaatgggataaagttagaaatcaataacaaactgaaaactgaaaaatttctacatttgtggaaattagaaaacattctctcaaccagtgagttaaaaaattacagaaaaattagaaaatacttagagatgaagtaaaatgaaagcacaacataccaaaatgtatgagatgcagcaaaaacagtgtaagcgggaagtagctatatatacttactgctgtggaattaatggtgttcccacaaaatttatgttgaagccctaacctccaatgagactttgttagtttgttggagataaaagttttaggaggtaattaagtttgtacaagatcatgtgtgacgctttaatccaacaggactggtggcttaaaaaacagaggaagatctctcactctttctcttgctcttgctgtcactctctttcactcttgctctttgtctctctgtgcatactcaaaggaaaagtcatgtgagggcaaagctgccatctgtaagccagtaggagagctcttaccaaaaactgaaacatgttggaaccctgatcttggattctttagcctccagcactgtaaataaatatatttctgttataaactgcactgtctttggtattttgttatggaaggctgaaaggattaagacactcacattagaaaacaaaaaaagatctcaaatcaacaacctaattttacaactgaaggtactcaaaaaagaaaaacaaactaaacctaaagatagtagatataaacaaagtagataattaaaaacagagaaaatcactaaaatcaaaagttggttcttcaaaaaaatcaactaaattggcaaacctttagttagcttgactgaaaaaaaaaaaaacaaaaaaaaaaaaacaagagaagactcaaattcctaaaatcagattgaaagtggggatattatgaccgtttctacacaaataaaaaggattataatagtactatgaacaattgtataccaataaactggataacctagacgaaatgaagatagtaccaaaaatgcaaaacttcgtagtagagtcatgaagaaatagaaaatctgaataggcttatagttaatatggatattaatgcagtaatcaaaaacctcctggccaaaaacattctggaactgatggcttcatgggtgaattctactaaacatttttaagaaaacctaacaccaaggccaaggcgggcggatcacctgaggtcaggagtttgagaccagcctggccaacatggtgaaaccctgtctctactaaaaatacaaagattagctggatgtgttggcaggcacctgtaatcctagctactcaggaggctgaggcaagagaattgcttgaacctgggaggcagaggttgcagtgagttgtgatttgagatcatgccactgcactcctgcctgggcaacagagtgagactttgtctcaaaaagaaaaacaaacaaaccaatatttctcaaacttttccaaaaagtcaaagaggagaaagcacttcttaacccattatctgccagcattatcctgatacaaaaatctatacatgctacaaaaaacttacagatcaatttttcttatgaacatttatgtaaaaattctcaacaaaatactaatacaacaaattcaactgtgtaaaagattatacaacatagctaactgggattcattcttgaaatgtaaggatcattcaatatataaaaaactgatcaatgtaattgtattagtcccttctcacatcgctataaagaaatatctgaggatgggtaatttataaagaaaagaggtttaattggctcacagttctgtaggttgtacagaaaacatggctgggaaggcctcaggaaacttttactcatggcagatgggaaagctggagcaggcatcttcatgtggctagagcagaggaagggggtgagagttaccacacacttttaaacaaacagatcttgtgagaactcactcattatcctgagaaaagcacaaaagtgatggtactaaaccattcatgagaaacccactgccatgatttaatcatctcccagcaggcccctcctccaactttggggaacacatttaacatgagatttgagtgaggacacagattcaaatcatgtcagtagtatactacattaatgaaattaaagaaaaaaaacacataatcatctcaactcatacagaataagcatttttaaaaatttaacacccttatatgactaaaaaaaaacaacaaactagaaataggagaaaagtacctcaacataataaatgtcatcatgtatgcaaaatgaacggtgatcattatacttaatggtcaaagactgaaaatagtttctttgagataagaaacaaggcaaggatccttccttttgaaacttgtattcaccacagtactggaagtcctagcaaaagcaattaagcaaacaaaaaaataaaatcaattcaaatggaaagaaaaataaaattatttccatttacagattatataattttatttctttaaaagcctagagtccacacacacactcagcattttagaactaataaacacattcagcaaagtactaggataaaaagtcaacacagagaaatcatatacatttgtaagtctatacaataactgtgggcaatctgaaaggaaattaagaaaataattttatttacaatagcatgaagaaggatagaatgctaagaaattaactcagtcaaatagatgaaagactcatacaatgaaaactaaaaaatatgtctgaaaaaaattaaaggacacataataaatgtaaaggcataccatgttcatgaattggaagatgtaatcttgttatgatgtcaatatgcccaacacaatctacagattcaattcaatccctatcaaaatccaaataatgtcttttttgcagatatagaaaagcctatcctagaattcgtatgaaatttcatagggcttcaagtatccgaaacatttgtaaaaaagaagaaagttggagaactcacactactgattcaaaacttactacaatgtatagaattcaaaatagtgtgacataaattaactgtgctggtacaaagacagtaatatagaccaatggaaaagaagagagagtccaaaaataaactttcgcatttatgatcaaatgaaggtgccaaatcattgaatcaggaaaggactatcttttttaaacaactgatactggaaaaactggatatccacatacacaaaaaataaactcttacctaatatcacattcaaaacttaactcagattggatcaaatatctcagcataagctctaaaactataaaacttttagaagaaaatataagtcagaagtttgaagatattggaaggaataaatgaattgaatcattttgcagtgctttcttggatatgacacaaaagacacatgaaattaaaaattgacaaattagattttatcaaaacttaaaacttttgtgcatcaagaacactatcattggagtaaaaaggcaacatgtggaatagaaaatatttccaaatcacttatctaagaagaggttaatatagaggaataaagtatacaggagttcttatatagagggattctaaaacgtaataaaaagaaagcaacctgattaattccaaaatgggcaatgaacctagatatcaaaaaatatgtaaatggccaataagttcatcaaaatagcaattcctatggaaagaagtttgatcttaatatgaagtggaaccttaggaattaaccattttcggtaggtaaacacaactgaatatagatgccttgatataattccatcgcagtaagtagcaaagtgtaagttaaagtgagctaacatttcatgcctatataatcatcaaaagtttaagtttgataataccatttactagtgagaataccatttactagtacacaatagggacatgtatatcctgccaaaggactactagtgacacaatgaccttgaggaacaaggttaatttccttgttcctcaaggttaagttccttgttcttcaaggtcaagtttgtagaacttagtcgtgttgaagaagtccatctctaaccctcagagagtgctggtgggcatttaaaatggtacagcctctttggaaaacagtctggtatctcctcaaacaattaaacagaaagttatcatatgatccagcaattccattcctaggtatatgcctaaaagttcccacaaactttgtacgcaaatgtccacagtagaattattcatagtaaccaaaaggtgaggaaaaacacaaatgtctgccaacaaatgaatggataaacaaaatgtggtatattcaaacaatgaaattattattcatacaatgaaattattcagccacaagaagaaatgaagcactgatacgtgctacagcttggatgaaccttaaaaacatgctaagtgaaaggagccagtcttctttcagaagtcaaatatgatttcatttatgtgaaagtccagaatgaggaagtttgcaggacagaaaggagattagtggttacttacagttggaaggattgagggatcagggagtgatagctaaagtatatgggacttctttttgagataatgcaaattttataaaattgactgtgataatagctgcacacatctgtgcatacaatacaaactataaatctgtaatttttaatgggtgacttgtttggtatgtgaagaataggtgtttttctaaagaaagaactggtaagtcctacaacagtaagttaggcattcagttgaaaaggcttgtggtgcaagaaggtgtgtcatttttctttttaaacaaatgtagccttataaaggtcagaattactcattgtagaacgttttgaaattgatataattaataaaaacagaaagtatacttatctataattgtatcacgaagaatggaataatttcaaaaatcaggtgaagggatttcacctttagaaggaaaaacatagtactaattagaatgaatctagaatcaagaagctcaagtccagattattttccattcttttccttactcattttttaaatttatttattattattattattttgctttgtgatttagggagagttgaaggctgtacgcttaaatttacttacattacaaatgaaagatggtcataactagttccagttttgtttaagttttaactgaggtatgtcaagtgtatcagttaaaattctccagaaaaacaaaaccaataggatatatatctccatatatatagggagagggagaaggattttaacgaattaactcatgcaactgtgagggctgacaagtttgaagtctatggagcagaccagcaggctggacaagtattaatgaattgatgtttcagtcttgagtcctaaatctgtcgggcaggttggcagttgggaaagttaggcacaatttcttgaagcagaattcatttttggggggaaacttcatattgtacccttaaggccttcagctgattggctaaggaccatccatattattgagaatattcttctacttaaaatgaattgattgtaaatgttgatcacatcgactaaatacctccacagcaacgtctagactagtgttttaccaaacaaatgggcactatggcctaaccaagttaacacaagaaattaaccatcacagtaggtatgacacttcacacagtgagaactcaagaaataatagctattattttgttcccacctgttctttcctacaaataattcacttaattcagagcctcatcatctttcacctagatattttagtagcttattttctaaaatttgttctcacatctccagtcattctaattcagccaccatccgcagaaatatatgttaaaattgaatgtacttaacagactcccacaaggttataaaatgtcattgaagtgacactcaatgtcattaatgtaactaatgtgacaactggtccatcatctgagctcctgccactccagcacagagcacatatttttctctacctgaaccaaactctttgtgatttctggatgaaagacacctgactcctctgtgtctctgagtcattcctcttggtagacctagccatttaaaaaaaaaaaatttccttcaaaagtctttgttaaatactttctctcttcttctctgataatttttttctaacccttactccatgctaagtgaatagttcgctttttgggattctggcattcctctctctcaaataatttttaatactatttatttatgttgttatcttctaccactaactgagggggaacacctagaatacaggatctattaaacattttttctctctcatttgtttttctcctcctccatttcttcctcctccttttttgtaaaatttactgtagctcaaggcaaaatgtaagtttaataaatttctggttgctttgagaaactgatgaaagacttattgttatttctgtgtaaaacaagaaaccaaaggttttgaggattgtataatatgggaaaaagtcatgtatgagaagatagatcttgtaaaggaggccatgatataccataagctattgaatctggaagcagggagctaggtgtagaggccatcattataatctggaactgcaatgataatcaaccatatatcaatataacaagcttttatgctgagatctaaaatttgattgctattcaaagataaaaattatcttataaacctaattaatgtaaatgaaatgaggcaaatattaaagaagtgtatttctaaaggtttctttttctttttacaaaaatgtcctctttgagactccttccctgaaattgctaatatttgtttaattttttatattgttgaaaaatgtaatgtttaggtaattcttcaaatacaaacaaaaattatccacatctctctatcacctgtgtttttgctattactaggaatttatcttaaaattttattaaaacctcaaattatgagcaatggtttagtttctttgggagactttaaatttgtgatataatctcttacttcattactaataacaattgtgaactatttgatcaatttttcccgagtagtatttaaggtagcacttttcaaacatatctttgaaatctcacatttcctactaaaagtcaatgagattttgcttcatattccattaaatatctatgctttttaatacaaaagtaattatttttaatctcatcaggatgtgttcaagaaatgtatgataagcatacacaaatatatttgtgtgtttgtatgcacacacacacattcacacacgttactgctggtgccaagcacgttctgggctgaaagtcttggccttagagtcctattataccagagctttaatggaagtagatgaggaacaaggccagcaattgacgaattctatttcaagttagttatttaactgtagtttgtatgatgctcatttctagttggtagaatgatgcagggaaaccactagggagtgaagccaaacaatttacactattaatatcaagtgtttgacatgatgagtgtttccaatataaataaatttggaccacttttttgttgttgtttacctcattcatcttcattagtgaagataactgaaatccgattaccttttcattttatctgaaacaaaatcgaatgttcctgcttttagttgcagggtataaaaacaatctcccttaccacattgtagtattgccccatatctaacgtctaatgggtctcaaatcaaatttgagatcaggaaaatcaataccaagcagctcatatcatttatttactaaatatttgggccagaaatagtaataaactgtaaggggataagtctgtttgggtttaatgggggggaaaaaaacaggaaacaaaacctcacctttaaattatcttaactatcttcacttataaatttgcaatgtatttaggtatatatttacatgaatatattacatatgtaaatgtaacaggaaatacaatgtcacataaataaaatgccttaacattgtgcaggtatgtgggacaaatatgcaattatgttatataatttaaaggaaaattaatttgcattgctgtgtaaaaatcacctacacatcaggtgagcaatcccacaaacttcctttaattcatatttaggcaatattttagtcatttagaaataataaggtatttgtaatgactttatcttttttctcttgttttccaatgtaaatcacaatttctgtggcacgtcttgtttcatcctgctcataacataatattaaatattaaattgtggagtaagaaccatcaaaatcatgggattgtagattttctaactgttcacctgggtcatgcataatctaatatacacaatgtatactttagacagttcctgctaaggaaactatttgaatgaaagagcaatgtagatgacagttagtgaaagttcctgaatattagactctttctgtatcattgcaactaagcgcttacaccatacctattattcttacatttgatcagacagggttaacctagagtgatatgtcaagtttcatttgatcagcagtctaaacaaaaacttaagaaaaatgataagattataatagtatctaccacaagatgtgaaccatcttacataacccctgaggttaaaagatcccaattaggcagagttcagtactttagtgatttactgtgttttattaaatggcatgcagataactccccaaagggaactgtggtctgcattaatgtcgagactcttcatgtcagaaataacttcagacatctttcaagtggtgtggtagaggagctctccgcttgctctcctccttaagaacaaccaaagaaatgaaaataaaaaaagacagtacaatttttatgttacattaatcagctacagcctaatctataatctcaacggaacatagagtaaaaagaaatccacagccagaaaaggattgaaagcaaatatacactttaatagattttgagaaacacaaagaaatagacaaactgacaattttagctggtaatttcaacatttctcttacagtaaaacatgaaaaaagtagataggaaatcagtagggtataaaaggtttgattaacactatcaaccaaattgacataatcgacttttatagaacactatatgtgataattacagaatacttgacatgtttaagtgcacacactgggccataaaacaagtatcaataaatataaaagaattgaattcataccaaattatattctatgaccataaaggaattaagtaagaaacaaacaaattttacacacacacacacacacacacacacacacacacacacacactctctccacattttttattggaatacgaatatatctaataagtaatatagtattatacatctagtgattctgaatgtagattttgtcctgtaaatatattacacatgtgtctcaagacatacattgagaaaattcattgcaacactatttataattttaaaaacaaaatagaagactgaacacaacttaaattattattatgggactagtaaaataaactatggtacataaaataataaaatagtgacttcttcagaagccattaaaattaatgattcttctatatgtgcaggaaagcagtgctatccagtgataaaagaaaggtccatattgttacttagcatgttattattacaataggtaaaacattcccccaaaacaaaaatatctatatattatttaaatatttccagaattatgaataacaagatgaaacttaaattacagaattgattacttttaacatagcatatgaaaattaaagcacatcaggaacttccaaagtaaagaaaaaggtggcaaattgttatatatatggatatagatatagatgcagatatcttattttctgaagtgtatgtcagcagcaatgatcacatacaatggcatgagattctacgtgtgttacacgtgtcaaacataatcagagacaaaatagggaaagcaatatgttaaagtaaaaataattattgttttagagtagtagaataatgttggtatggtctttaacgtttatgttattatgttacatattgttttaagtgttagaagaggaactagaatatgaggagcaagggacataaaggactagacatttaaagctgaatttaaaaagcaactgtgacttggaccttaattctacttggtaaaaaagacttgctaataatattgaagttggctattaaaagaccgtggtaagtatcttatttgtttctgatgtgctctggaatggaagtagaatgcaaagatcattatattacaaattggtactcaactcttaattctttcaaaattatcctaatcactgtttctaacatcccagaactaaactgggatatgggggtgaataatgtcaagttggctgttcatttaagaaaaacaaagcttgtccactaacttttttgatttcccttatgttattcaaattcagtatcttccaaaagagctttttttggggaaaattttcaccatcttctaaccaattttatatctctaacataaaaacctgtccctgaaagcataatgacatttgtaaacatactaataattcagatctttacacttattcttggaattagaatcaaaactagatataaaccacttcaccctttaaaattatataatttacttgacattaataaattcttcttgaaaaggaaaaataaaaatactacacctggatatgatgaagaatgtactggaaaataacctttcacttcagagcaatcacaatgaaaagaactttgactaaaattgaataaatggttttacaaccctgatatagaagagcaattgctcacacatcaatcttcacgcaaattcagcaataaactctgacaaaaccttaaaacaaaccaacacataaaaagctacccaaggactcaagcctgaacaaaaccaggcagattttcgaagggagtgaaatttacaggaaaatagctcacaaaataggattcctccattttgttagttttgtttagagttttagcctaagggcaactgtagtggaggcagagtgtgggtatcaagtaagttgaatctctgataggaaatccgactgtcgtttaggcaagaccaagagaaagagcccttgagtagctgtaactgccagagaatgagaagaatccctgagagagtcagagcaggggtaactagtggtgtgcacgtactcaggcaagtgtttgactgaacttcaactataaatgacagaattttccgacgaagtctttaaagctgctattctaactgtatttcctgaccttcataaaaataaatgcaaaaggaataaaaagataggatatatcagcatacaaatacacctatcttaaatctattgatatatttatatatcttatatatcctacctttcatagacagatacacgaagaatattaaaaagaagaaaatggacacttgtagaatttcgaaacagtatttaaaataaaaaaaaaattggatgggataaagagcagaatgaagatgagagagaacagagtctgtggcacacagatcaataaacaacatttaatctgaaaaaattaagaaatttacaaaagagagaaaaacaaaacaaaacaaacaaacaaaaaacagacccctagggacctgtaggaaaactgcaaatctctaacagatggtgcttggaatctcagaagaaaaggagagaatggagcaggaaaaatatctgaaaaaaatgatagaaattccaaaatgcaataaaaaacacaaatttacatattcaaggtgctcagtgaactccaaacacaatatattcaaggataatccctcaaaagtaaatgttagcgaaactgttgaaaactaaagataaagagaaactgtggaagtgaacagagacacaacacaacatataagtaggaccaacattagaatgcttacagacttctcattaagaaccatggggaatcaaagtgaaataaagacagtttctgactaaagaaaaataagggacccacactacaaaatatgctcttcagtgagaaagaataatatgataggggaactcggatcttcaggaatgaaagaagaacattggaaatgttaagtatatgagtaaacataaaccactaaatttcctcttaatttctgtataaaacgtattactgttaaaagcaaaaatgacagtatgggggtatgtatgtctgtatgttgtgtgacaactataacgacaaaaatggtgagggagaaagaaaattatacatttgtaacatttctatgttttacatgagattattatcttccttaataataattttcacaaggcactttgaatttttagttactgataaaaatcagattgcctgataattttagaatttaagggtatgtggtaaatgaggtagtttattttcatcaaacaataatagcatcatggattcataaacaatgttcattttttttctaacatttggattacgaatacatttgaaaagttgaaacaagtcactataaaatgccttcaaaatgattgacttaaaatttttcaacttttttctagaacattatgagcttttaaaatttgaggttattttattcttattcccaaaacctaagatgtattcgcttggtagctaatctagttttaatcatgcagttaataaaatatttattaagtaatcctgttttgttggtagcctgtgttttgttggtagcctgtgttactcccaaaggtcataaccttcaataatatagttaataaaatgtggaaaatatttccacaaagaaacaacaggacttgagtttttaaagaataagaagtttgcttttagaatctgtaatgtgttagtcactctggagaattcagttggaaaaaaatgaaagaactgaactgctgagatatttaaaatctagaagcatgaggtgataagtcaagaaatactttgggcaaaactgaaattcgtatagcacaatagcatgcagataaagctaggtgagtacatgttttttctttttctgtggggtgaggggagtgaatagtggattcgctgtcttagaaccacagtttcttaatttcaggtttgaaagttatatacattaatttgcagaaaagaaatagagaccttacaaaagaaaaaagttacttgcaaagactattagggacaatttggtaagtactgttagagaaattaaagatgagaaaaatgagggatacacataaagaatgggattgtcttggttgacctggaatgctacagtggctacgtatttgcagagattataaattgagagtcattctggattcttgtacatcataaaatggagtttaagattactctagctgttgtgttcaggatggatttattcaagaggagggtgattgtctgagatggagtccattgaaatgacctttcaatggagatttgaagtgctaatcctatataggtgtgggaatgaaaaagatgcacagttggtaaataatatgaataagagtgatttttgtggattttgattgaaacaaggcaatgtgaggaggccgagaagataaaggtatcagaaataacttcttaaagatgagtttgttcttactgctagactttgctgacattgagttgacacatatcccaaagtgttatgcaatttgaaagctgtaaaaataattggttcttaaggttacatatagtgatccatatattagttcatttttacttaagaagatatactttaaaatgcatttttaagagttttcctagaatattggacctataaaatggtctggttttttttttttttttttttttggaatcattgtctaatgcatttagcacagcagttctcaacctttttggcaccaggcactggttttgtagaagacaattttttccatggactggggcaggggagggatggttttgggagatttaagagcattacatttattgtgcacttgattactatgattataacattgtaatatgtaatgaaacaattatacaactcaccataatgcagaatcagtaggagccctgagcttgttttcctgcaactagatagtcccatctggggtaatgggagacactgacacaattagatttcataaggagcatgccacctagatagctcacatgcatggttcacaataaggttcacactcctatgagaacctcatgccaccactgatctgacaggaggcggagctcaagcaggaatgtgagcgatgggagtggctgtaagcacagatgaagcccatggttcacctcctgctgtgaagcccagttcttaacaggccacagactggtccatggcctgggggttagggacccctaatttagaaaatacaatatagtatcctagttctcaacattcgcaatgaaattagaaatagctttgaagagtcctgaattaaatatatatatatatatatatataaagaaactgtcttaattttatttaacacaatgtttcatagttgttttaccccacactagggatcagcaacttttttctgtaaagaatcatatagtaaatatatttggctttgtaagacaagagacaaaaccaaagttatgtaggtgcttctacaataagatagaaatcaaaccgctacaaaattttattgtagttattcaaaataaaataataagtacaatgttatgtaatacaagcctacaaatgaaaaaaatgaaatatgtttttgcaggttgcatgtaagtattccctgtcatcaagtccattgcaaatgttggtctacaaaaaccatttttactttgcatgctatacaaaaagaggaacagactagattctgcctatgtatcctagtgtgttgaacaccactctagaccatgaaaacaaatttttttgacatgatgcctattagaatttttttttagaaaatcactcttctacaatgaggagccaaaaagtagtaaatctgattggaatgaacctcatatgagaatgatttttttatgaagaagtagaaacgttttgatgtaaaaaaaattaaaaaaataattaaaagaaataggtagcaatgagcatcttgaggtgtgagttgataagcagcagtcatgagagagggcagctggaaattgagtcataaaggaagacctagacgtcagttatggcaaagaaggagaaggaacactcagaagagattgaattgagagtagaggtaagttggttggttatggagtgacagtttgagaatgtagagttaaaggttttggaatgctgaatggataaaaagccagggattattgaacattattatgggaatgataaattgatggaaggtcaatttttagtggcaacaggcttacaatctggggatgactggtgtgaacaggaatacatgacatgaaagatttatgtgatattgtctgtgtgaggaagggggtcactaagcctagtgtcagggagacttagttgctgtgatgatgggattcattgaagctccttgttctagaataaatgctattacaaagcatcatatttcttgaagcatgtgatgaaggattctggacaggagacttgcactgcaacctgagagactgtgcagataacttagaatctgggtgtacttcctcaattctcattatcctcctttttgtcttcctcctcctttttcccctctttggattacttttacattctcaggaatttcaagtctcttcagagagacttttatgaaagttagttcatgtcaaaccatcatctcttttaatctcttcttatcccatcatccatttataaagccagaatgtttatgcactggtgacacctgccccagaagtccactgctcattttctcctcagtcacattaaatcttttcaagagttatgatgccgagtcatcactgaagactgaatttggactttcctgtaaagtctagctgtctaaacatctgcttttctgcttctattcatttcaggttagtctattctaatgttaaagtatcacacagaaccacacccaccttccaccaaaggctgatgtgaaaaacagtccattttcactgagcacatgttgtttgtttactgtattaatacctgtaggagactcatatgggaaaggtgtttggaggttcagtttgagatatccttttaccttaattgttatattacagtaatgttgagattgttgctatcctgttcacttactgcttttccactagagcagaatgcaaagaaaataatttccagatcaattaaaaataaaacaaaagatcttaggatcatgatttttaaatgtcttgactctttatccatcattgtatctccaaaattggaccagtattgtactagccagtttttaggtggaactattcagaataatcaaagtaaacagtgaataatttttaagaaagtgtctccctcttatctctgtgcgttttccctacatctctcttgttctccaataattcttttacatttgtatcttgaccccactctttctctagcatacatgtctttgccttaacatttgcctttctttcctttgggttctttctatacacagcattttcaacatgtgtcatcttgatctgccttttctcatactagtttctctacttggaatagccctttctctgcttagaaaaatctactggatgggcgccgtggctcaagcctataatcccaacaccttgggaggccaaggcaggtggatcacgaggtcaggagttcaagacgagcctggccaagatggtgaaaccctgtctctactaaaaatatacaaaaattagccaggcatggcgacaggcgcccgtagtcccagctacttgggatgctgaggctggagaaccatttgacctgggaggcagaggtaggagtgaggcaagatcgcgccaccgcactccagcctgggagacagagcaagactctgtctcaaaaaaaaaaaaaaaaaaaaattatgaaaagccaggcgcagtggctcatgcctgtcatcccagcattttgggaggccgagggaggcggatcacctgaggtcaggagttcaagaccagcctgaccaacatggagaaactctgtctctactaaaaacacaaaattagctgggcgtggtggcacatgcctgtaatcccagctacttaggaggctgaggcaggagaatcacttgaacccaggaggtggcggttgcaatgagccgagatcgcgccaatgcactccagcctgggcaacaagagcaaaactccgtctcaaaaaaaaaaaaaaaaaaaaaaaagaaagaaaagaaaaagaaaaatctactggaacttgttggcccagctaaaataccatggctcatctgaagcctttttttgaccctcccatctctcaaccagattcagactgtttcatgacattccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttttcttttttcttctatctttacattttctttattaatacattttaaaactatttctcccaaatagcaaatatatatttacatgtttctttaaatgatatgaaacttacaatatcatttggcattaacatttgacaaaaatgctatttttccaggaagtctacctagctgttctgaccaaggtatcttttctgttttgtgtatcaatgtcttctccaatgaacaagcaaataatacaaatacagacattgatccatatttatgcaatggcaagtgaatgcggttcactaaggcggaagctgccttttagaaggattaagagatctaatctaaaccatatactttgctggtaatttcagctgaagaatttggtttttcttctttgtggaacgtgtagtaacccagtattgttgttgtcactgaattggacaatatcaatgaaaacactagcagacagtttatgttttgttatattggaaaatgcagttagaactgaagggaggaccaacagggaataatttattgcaaacaacccaacatgaattactgagaattaggcattactctgttgaatactttttgacatgcttttcagccccaaattaaaagttattagggcatattgtgatgtagttatgtatacatcataggtagtatgtagttgtatcccattgtaacagacagattaactgaagtacgagggatagccaattctatagaatctcatagggagaaaaagactcagggaagtattctaactgccttttattgcggatcctaagttatgcttgaatttaagtgattctcatcctcagtcatcatgggttcaattacatttaagttcataagaatactaacaggagtaaattaattctggacatgggcattttggaaccaagttcgcttttctatgattattttactggtgtacattgtgtttgaagaatatagtaaaaaaaaagttggatgtttctgtattgcaaaaacaaacaaacaaacaaacactatttattcatttgtggccaaaggtgccttgaaattttatgaagtagtataaaaagtcaagctgtgggaaaaatgtgcatgggagataaccaagcctagtcccaccttctgcatttttcagtttgttttcttatcagcctgcccataaactggaaaagcattaggcacaaacccactgataagcatatgagaatttcttctagtgtccctcattcttctttatggaatctgttataagaattttggaatccccatttgaaatacaaagagttacaatacaaatgtaaaaacaaattattgtaacgtcagaggctgaaatgcatatgcaggatcccttttgttaatctttggatgaatgagagggagggacacctacctgggaagaaagagtagtaaattcagctcactaccaacagaaatgacagtgaaggactttcttaacattgaggctttgaaggttaaactgttgcatgtcactttccaattaggatgcctgggagtaagcaacagaaatagactcaggcttacttcaagagaaaatgaattcattaaaaatattactgggtgcagcacaccaacatggcacatgtatacatgtgtaacctgcacgttgtgcacatgtaccctaaaacttaaagtataataaaaaataaataaaaaataaataaataaataagaggacaggctttggagccaggctgcctgtatttgtgttaagtttcaccattacctaccagctgtgtaaacttgggcaagttacttaatgtctttgtcctcagtttcctcatctgtaaaggataattttaaccacttcttaggtttttgtgagtgcttagaagcaaccaacaaatgttagttctcaaaaaaaaaatatatatgtatgtatataagttctcagaatcaaagagaaagttggaatttcaggactggaaaatgaacaggagttaggagggcctacacgtttttgaacataggaatgtgttcaggaaaatctgatgaggttgctgcaactggaagccacgtgaatgggcatgcaccacatcacccttgctggatgctgagggtctgctgttgctcttgcgaataatttttcaattacagttttattatctcaaaattcagggtcctgggtgggggcatgacctaaggatattttatctggattttgtcttatggttaaagactgggttgtactttccactgatactcacataatacaaggatcctccaaaatagaaagggaagtcagatgtggagtagccaaataagaggaaaaaaatgtatactaggtagccggtatagagaaaatgggtgcgtggtcattaatttaccatctttaaatgcatatacttattttcagcgtaactggataaaaatgtctgattctttctaaattgtaattatatcttttatcttttctagcaaattacttactactagcttccagtaattaaaaaaaaaaaaatcaaacatctatgtacaggtacactgaccaatatccatgaactgattttggttgatttaaacctgtagacaaccatgagaagtattaatatcacatctttacaaatgagaaaacagactcagagagatgaagtaacacgattgcccaaatattacaaagagcaattgacactgtcaggatgagatctcatgtctctgtgatagaaatttcatttttctacagaaccatgaaaaaagttatctttcagataacgtagctgtcatttcattcactattgactatctctacatttcttagatctctttttttctgtatttttttctttactaaaaatcgtgcttttatttttattttctattttgagttctattgcaatcagtcatattaggcagtaacattttctcctaaattaatgccctcatccattggttttatttttccttattctccatatctgtattaatttgtgtatggttttaatgaaaagtcacattataaaataagatcttgtatttttttaatctttataacctcaaggctcagcacagggcctagcacataggaggtgcctgatacatatttgctttatgataatgggctcgaagaaggaaaataaggcatgacaatggggtggcaaaggaaaagtgaaaaaggagaaagttgggtagagaagaaaatggatatgcaatgactagataaaaccatcttctagcacttcgacccgcataaatcaacacataagggatttttaaataacagttataatattgataactgtttgtctcctgtgggttccagtttatttctcggggcctgtaaatatttttcttaatgttttcaattaccaaaatgatttattcatcacgaggtcttctcttatgctaaataagttttatgaactgacatagccaagagaaagtctgttattatattccttatattccatttattggagttggtctttttgctaacttttatctggtatccatttatctcctaaaaagcgtggattaaaagataaggctttaggactggtaagtgacttacataattatgaatttaagacaaagggacatatttcatttctttgaaaatgcataaagtgctgcaaaggttttaagaaataagaactctttgaaagggcttcctgatatgaataattgcaaatgtcaagggatgagagtttcctgatagtgattctatttctagaatgtcaggtactgatgcaaaggtgacatgagtgatttgaatgagttgttctatgtctcagagatggtcccatagagaaatgaaagcagtgctttataaccaacagagagatttatttaagaccaaaatgtcagaggtaatcaaactgtttaatttgtgctcatagttttgctttgcattatataactggacacacagaatttattgtatactgacaaattatggaaacagaattttataaaaagtaaagttgaatgctgcattgtggctttcagtaaattttgataaaagtctttatggtaatattcttaatgaagtataaatgctgatatatattctatataacatttttccttttgctttaagtttatattagcatgcatgcaacaaaatatacagaactgatcctcgtgaacacttccatgtgcatggtgccaagtgcagaaacaaaacatcgttcacactattgaaaaacctgtattctgacacctaccagtaactatttacccacaaagataatcattatcctgatttgtaacatcgttattggctatcacaaatagcattaccaagaacatttttgtatgcgtcttttgatacagaaatctatctatctacccatataagtttctgttaggtatataccttagagtggagttgctgagtcagacctatgctcagctttggtaagaactgtcaaaaggattgacaaattgattgtaccaatttattctcccaccagcagtgcacgagggttccaattgcttcacatccttggcaacacttattagtggctctctttttcattttagccattctaattataataccaaaatattttgtgtgtgtgtttgcttatatatactcctactaccaaaagaatgtaagtgacataaatcaaaataagcacttttcatttatcaatttatacatcaagattttaaagagtaattcctccagatggtttctagactaaaatgcagcatattgcttagaggaggaaacttttcttcaatattcgatgatccatctaaaaatatgtcttaaatatttcaaaaatttatatttattaaacaaatataaaggttttgcaacagcttatgtagatgatggaattcaaggtgtcttattcttacaatatctctgataaaaaataactgtaaatgtacttatatgttttaatatggtctatatgataatacttttttatttattgaaataaaatatagcatgttggaggtttctatgtgaaatagaaacctaatagtgattctgtttcactgaagaatttccatgtgtctcatttatttccaaaacaatattacatcaaattaaaagacaaatatttagtttattctaagatgtgttcttaaagacattgataaactggcatgactaaaaaattaaatgaaatcaaatttttacctcataaaacaaaaggtctaaggttccagataaattttgaagccagtgttttgtcaggggccatggtaaggctggaatttgggtggtgggccgggagccaaaaagagctgaggatatggttgctggaatgttcaagttctattaggcagggaagaaggtgagaacttcataggctttgaaagatatgcaaccagtgctaaaaagagccgcagtgattgactctggaaggtgaagcttaggattcaagtgggagatactaaaacattggcattggaattcacaaacattttaggcatgtacatttaagacatatgttaggaatcatgactccattttgccaattataattcctgttaggcagaatatctgaatcattcttctgccagcagtcccccatgtccatcacctattctgtaactatcaccaattattttccccaatattttcctaaagctgattaaacactcttgggtcataagaaatttacatttgtcaataactgaaaaaagttggttcaaactatgtgatctagccttcaagctgccctatggttttgtacaaatttaacctttagagcaaccatatcatcatatgtatattatcacaaaaattaatgttggtactttattcataaacatgtataatttacatacataaacttgtataagtcatgtacaacaataaatatagtgactaatcatcagggaaatgcaaatcaaaactacaatgagataccacttcacacctgtcaagacagctattataaaaaaaaaagtgttggtaaaaatgtggagaaattggaactctcatacactgttcagtatacaaaataatccaggtactatacgaagacagcatgaaagttcctcagtaaattaaaaataaaactaccttatgatctagccgtgccagttctgggtatttattcaaaataattgaaattggaatctcaaagagttattagcactcctatgttcattgcagccctattcacaatagccaggatgtagaaacagtctcaatgtccatcaacagataaatggttaatgtgccatatacatgcaatggaatactatgcaggttttaaaaagaaggaaattgtgcaatatgcaacaacacaaatgaaccttgaagacattaggctaagtgaaataagccaggcacagaaagacaaatactgcatgattccccttttatggggaatcaaaaatagtcaaatacatagattttaagagtgaaatggtgattgcaaggggctgagggagaagggaaaatgggaagttactaatcaaccgacacagaatttcagttgagtgagattagtaagctctagagatcagctggacaacattatacctacagtcaatgataattcattgtacgcttacagatttaagagggtagatttcctgttgtgttcttatcacacaatttttttaactctttgcaatattttcctagccttttctgcttgactacctgctttccacttctgtaccccactgtacctcctcccatattaaaaggcaaacacagatccttccatagtctcttcatgcttttgtgtatttgtaaaatagagtcatgtatcacttgatggggatatgttctgagaaacgtgtcgttacgcaattttgtcgttgtgcaaacatcatagggtatatctatacacacctattttgtatagcctactaggaataggctatatggtacagtttattggtcctaagctacaaacctctaaagcatgttactatattgaatattgtgggcaactgcaacacaacggtatgtatctttgtatcaaacatatagacacgtagaaaagacacagaaaaaatagaatattaaaatctcatggaccacccttatgtatgtggtctgttaccgaccaaaacattgtaatgcagtgcatggctatattgtacaagcaactatagtcatccatttttgtactgtttcagtaaaggtttccaaatgggaaaacagatattactctagtggtccagatagaagagatttaatacagataattgttacaaacagtgtcgtaaaggctggaggggccaaagtggtggtatgcagaacctgtaaacacatgttgccgttatcaaggcaggaccccgggcttacactcccgtcaccactgccactgaggtcctattgctgaggctggtgtgccagagccactgccagaggcttccggtttctgactggtagagctctcctttttttgcagaaagtaactagaagtcaactagcaaagaagctgagaagactattttgaaaggaagtcttagaaatgtaaatttcaggctttctaaccacccccagtaataaaaaaccatataggggcagcagcgggactgacgaccaacagacaacctccaatgtttatgtgtcggcgagattactgatagtataaatttatgttagtattgtcattgtctggtatacaaagatgggcttccgtcgaattctttgttgtttttgcttttctttggttttctctcttgcttttgtcacttgacgatatctcagtgaaatttttccaagtcaactttattcttttccaagcacaaatttattctcttcaagtcatgaatgttattatatggtgtggatgaatagtaatccatccaggcattcgattatgatgagttttcatcttgactctgacaattacgaagagttttcactttgactcttctttttagttgaaataaacatcactgctcattgctctctgcaggttggtgtattttgttgttgttgttgttgttttttgtttttttttttttttacacggctaggtcccaggtttaggattgctggtgagatggaatatgttttgtttgcaattgccattttatattcccaaatgggaataacacattataatttcacaactaaattagaaaaggacagttttcactgcatccctgccaccaataggcattatctgggatactttcttaattacaattttatttcccagaaagcaagccatggtggaatgaatgcaaatactatcccaactccagtgtaactttacagatctttccaaaccattataatgcatggagatttttgaatcattcaccattttcaaatttaaaattgtcatgaaaattactcaaatcagtgaaggcagaatagcgtttcagtaatatttcagctaaaacaagtctaatgtttaattatgtatcttttattttgtgtttttattttcttttaagatggctaaaattttgtgagagtgctgctattgtaggtttgtatctgccattgtcgcaggttgaatcacttatggtaagctaatttatattgtaactgcattccaactcaagatcttcatagactttaatatcaaattttcatttcttgccacatgttcatcacaagttgtatgtcagtgtggagagaatctgcctaatggctcttcacccagaaatccaggctgctaggtgtccagcatctggtgaatttgctggtagttgtggcagaagagaaggtggcaaattaaaaattgactcttaaagacttctgcccagcagtgatgtatattgggtccaatcatttgttaatgagcaacattgactaacacattgattcgaatatcccttgaaacatttatgacatatttcctaacttgacataatgcagcacatagtatttcaattgttcttctatttttttttgtggtgactttacccattttgaattattttatgggtagagtaagaccattgattttgaaaaactggaagttgactggctctgcaaattgaagagttagctggtaaaatagctttccctttttatttgttgtgctgcttaggtgttgtgtttgttcttgcattgctatagagaaacacctgagactgggtaatttataaagaaaagaggtttaagtgattcaaggttctgcaggttgtgcaagcatggcatacacatctgctcggcttctgggaaggcctcactggtgtttactcatggcagaaggtaaagcaggagcaggcatatcacatggctagagaagcagtaagacagagtggggtggtgggatgccacacactttcgaacagccagatctcacacgaacccactcatattgtgaggacggcacccagctgtgagggatgcatgcccatgacctaaacacctcccaccaggcctcatctccaacactagggattacatctcaaaatgagatttggcagggacatagatctaaaccatatcaggcgactcactgaagaaaataatagtataaaatattatggcagtttaatcaataacattaggataaatagcattagtgtgtgtcatattttcattgtgattaaatctaaatgcagcccttgatcattgtcattggggtccagtttaatttcctcagagtgctcagacagtacctggggatacttgcagctctcaaattgttactaatggttagagttttcaattatttttgaaacaaatacaactcaaggataaactttgataattgaaaagggattaggatgttaaaaatgcacactttcatgaagacagctacttattttttatccactgaagaaaacatcttatggacattctctcatattacagctttcagtggcatggcattagaattctgattccatattgcttgttcttctacattgaagcagatgtcagtttcatatggattctgagtatccagtctgtcaaatataaatgtaattactggtcaatagttttggataatttttacatctgttgaagttgtggaggttttattaattattttgacttagattttattcccttcagaaagctgagaattcagaaccatattactttgggtgaggtcacctccactcctaataagagcaatatgtgctgagtagtcccggtgtgcatgatctgtgctgttatgactcacaagtcccactagaagtttcaggtacaggaaaggaatttcctccaaataaggaaaacgttgtgcacctgtgttgtatactgtttgtgaaaagcaagaggatgtagtattggaaaggtgtaaagcttatgctttagttggctagaacaaagttcatattttttctcagttatcaggggtcgtgaaagtcattaaatccaacttctatccagtgttagggaatctgagaggtaattctcaaacttttgcctaagtgtgatccacataattttagtaataagcttatttcctatttcattgtctcacctgagaactttctaactgaggtggaagcaataaatattatttgttaatagctctctcctcctccatgtcccttgccttcctactattaatactaccactattgctgctactgttctgctcctactcctaatacatatttaactaatataacatgtactctaccagacaaaacgttgggataatttacatatcagctaaagctgtagaggcttcattttgacttagagtttgttgcctccaacactcttaacattgtgaaccaggttatcttgtgtacagtccaccctgcttttagtaataccccaatgtgctatttattctgcattcatcatctcatttactcttcaccacagatctgtaaggtatgtgtgagccttattcacattttataaagtagaggaccgagatttagaaaggttaagaatgttatcaaggtcattaggattttaaatttaggctgcctggctataaagtccacgcttgtaaccaccctgcagtaccctcctttcattgtttttatttatttttaaattcttactctgatattgagattctcacctgtggtataaaaaagatcctgttgtagcggtggaattaataattaaatacacccacctgtaaatgcttgttaaatcaccagaattaaaatagaatatccatgaaatgttctagatgttcaaattgctcttgtcactgtgcacaccaagatttaaaacctagggcctcgtaagtattcagacaattgtcttggaagatcttgtgttttctctatttgctactgtgtgttaattctataccatgctaggatacaggggccctatgccatctttcaccttcttagtagaatgtttgatctaaatagcaatttggcttgccctggacaatgttgtgcttcccctaaccaaagaaacatggttctctggaagattatagtaccacattggtcagcagtttcaagtatttggcattgaagacattgtaaagcgaattataaataattttatcctgaattatctatatcataggcacattgtgacattgtttagtttgcaccattgttcctgttgttggggctattgttgatattattttggcagactgtgctatgttcaaattaagactctctctggaactctcagttataaggttattattattgccgtactatttacaaaagagttgccaagactggtgcactggaagctgtgttccacttatcaattcaaaggaattttagtatcgtttctaccatcagggaatctgtgagctgagctagatagaatcagagagattatctagagattattttattgatcaccaaatgcatttttgtaaaagtaaagaccccaaattgaagctcttcaaacagtcagttggtgttactaaaatggcttatagttacagttatcagtctcttgagtaagcaaaatgttatctcaaagccaaaacaattttgtggtatggagagagattattaagtagttgaaatattgttgctgaaaatatggatttaaaagcatcaataccaagtgccatggaatttccaaatgacaacttgatattgatacaataaaacagaaaaagccattaataattgaaagcaataaaaacatatgccttgaataaaaacaacttgaagcccgtaaataatacaacatggctattcagtgatcattctgtaatattaaagtttcaaaaggcatcctaacgtgttggattttttgtttgtttcacatttcctgatccagatttatatttttgaaaataatatctactatcaacctgatataaagagcagttcattgcgactgacatcttctggaaaagaagaaataatttttaatgggattgctgactggttatatgaaggtgagttgatcagatttagtttcaaaggaaacaaatgacatatttttatacaaaatctaccaaaaaaaatctattcattccggagcaatacttacagtacagtttcttctcattttctctcaaaattgccctcatgctttcatatctttgcatgtgcttatattttgtgtggttgagatttacatctacttacatgattccatgtttggtgtatatatgtacatataggctagatagatattatttgtgaggacaactaatgaaagtaaatggttaccttatgtcactttggaattagatgctgaattttttctgactctctgggaaagaagaaacagaaacctttatttctaaaaaaaaaaaaaaaaaatgcataaaaagccacctgattttagttatttccattagggacattctgtcacactttataagctattgcagagggagcaaaataaaacccacataaagagttattttcaatatctattgaatcaagttttagtaatagctgagaatataaaaataaatcaggtgatgaaaatttatccagtttttatcacgtaccaattatcagctgagttctacatatagattgcctgggcaagactcaaagtatgagtttattacctatgtttcagattcttcagctgattttggcaaaatatgtcaagatttaaagtaagtctactttattataaattataaagctatgaatcattcaaaaagtgaattttatttcatgggcaatatttgcaaatgtaatctctctacctcagatttgacatttttaattctataagaaaagtgaataacttagaccaattattcattcattcactctttcactcaaatgatatcattgaaggcctactgtattctggatagatgtctaggtgccaggataaaagacggagcaaaaagtactgctctaataaaccgtatatttacgtgaaatattttgttaggtggagctattttattaaagaagagatgttgtaacccttgagatttatatgtatatgtgtacatgtatatttatatctataatagatttctgtgtacatgccagcatgaaataagatttttagaggctacaatttattgtgaagagcagtgagagcttccccgaaaatattaacaataagtatgctgtgaaagtatatattagaaaaagaaatacacaggtaaggagtgttcattggttgagagttacagaatctaaatctggcttttctatttcaaagagatacattactggaggggactgggatggccctcagaatttaataaacaggtggacaacacatttaaaatctggttagttctggcagtctaggtagcaggagctaattgaagtgcagagactaagacgtgccctttttcttcaaaatattattggtactgtgtgacaccctgacagatgaagaaaccatgttaatgcagtgtggtaagtagttgaatcttaatcaacacagaattctatggaagaacaaaggaatgataccattctagggatttgcaagcattttttctaaaggagaaaccctggccaacaacagtagctcaagcctgtaatctcagagctgtgggaggccaaggtgggagaattatccaaagccaggagttccataccagcctagacaaaatagcaaggttttcatttctactaaaaaatttttaaaaattagccagatgtgatggcatgcacctgtgttcccagctgaagtgagaggattgttaatgagagaggattgcttgagctcgggagttgaagactgcaatgagctatgatccaggcccctgaactccagcttaggcaacagagtgagatccttacctcttaaaacaagggagagagagaaaaagagagagagagagaagagagagagagcatctgagtcaagcctgaacagttaacaagtgttacgcatgagaagaaattaggaaggaaaaatctaagcagatgtaacaatttgcaaaaacccacaagtgtgtccctagggaaccaaagtctccttgatataattgggccataaaatttgagacaaaggaaggtagcaagaagcgagggatagtgacctctatcaatgatttggaatttcaattattttcctaccatttaataggaaaactaatagaagttttcaagtaagggagtgacaagattggatcttccatatgaacagattgtttttgtgacagcaggaacctggggtctaagagtggaaagaaacggtgagcggctgtaaggcttcttctatgttctatcaagagataatgagcaatggaactagggttaaagcagtaaaaaggaggaaagactctaaaattgatgagacaatgaaatatataggtcttagtggctaagcagatggggtgaatgataagaagtcaaggatgattctgtgtcttctggtttgggtcactagtaagtagtggtggcagacatagtgagcaagcattaacaaggagcagtgggtttcagggaagagaagactagattagcagcaatgcgggcattgaaccacgtactgacgtgctcccttggtgataaaaggtggtctgtaacgtcgatgaagttttcagtcaactgagggtatactcaatgtagaccatgcttattgtgctgctccgtcccgaattaagatgacttgggtctctgtcctattgaaaaggcttcatacatttataaggaaattttaaggagagaaattagagaccgtttcctgacaaatacggtaattttcttaactaaagaataaaaatctatgtattcggtctgagagtaaactgtttgtaggggttgtggagagcagaacaaacgggtaatacaaacttttgtgatgatgctgtaggtctgacgcattccaaaggggaaaggaaaaagtatagtttttgccatactttgggctcctatgttgccgttaactaggaaatgctgtacgtgtatgtgatttaatcatcaaaatgtttgtgcatctaatcatttatgaagaaactaagacgcacccagtgctgtggctcatgccagcaatcctagcactttgagggggcgaggtgggcagatcacttgagcccaggatttcaagaccagcctgggcaatatggcaaaatcctgtctctactaaaaatacaaaaaaaggctgggtgtggtggctcatacctgtaatcccagcattttgggaggccaaggccggtggatcatgaggtcaggagattgagaccatcctggccaacatggtgaaaccccgtctctactaaaaatacaaaaattagctgggcatgctggtgcgtacctgtaatcccagctactcgggaggctgaggcaggaaaatcgcttgaaccagggagttggaggttgcagagccaagatcatgccactgcactccagcctggtgacagagcaagactctgtctcaaaaaaaaaaaaaatttaactgggtggggtggtggggtagcacatacctgtgttcccccctactctggaagctgaggtgggaggatcacctaagccaggaagttgaggctgcagtgagccaagatcatgccactgcactccagcctgggcaacagaagcgagaccctgtctcaaaagaaaaaatttaaaaaagaaaccaagactcagagaggatcagtgatttagacatggcctcagagctaatgagtgggagagccaacatttgaatgtgtgtcttttgttcctaaagccagggcttagtcactagtctactctacttgttatagggggatgtccttcactgttccccaagacacaacacacgttttgggacctaaattgtcagacttcagtgatctgtttcctcagccaaagactcatcctactgtccatggacttactctaatcctcactgcatttccaggaggaaccctacccatgacttcaatgttaaggtttggcagagggatgtaagctattcagatgtttttgattttccctcactattttgactgctacccccaacctctgcttcaagagtcctacatgcaccttaccctcccactatcaccttgcttgtggaatgtgccaggagctcccaagctccagaccttttttttcccctttaatgcactcactgaaacacaatgatattgcctagggaatgcatgtaatttcaacgttatgtgtgtgatactctggtgtggagatttcctttttattactttacaggagtcaattacaatctaaattagcatgtatgggagacacagaaagtaacatgtaacatttcaacttttttaaaattgaaatttaccttttgtaaatgtcatagaaaaaaaagatgagagaaagagtgacataaaagacaataaaatatttttacagtaagctttacaggcatgtcttaatcttttaagaccaggccaatctgtaagagtggctgctgcccccaactagtcactaaatagagtccttaaaagtgtcagttttaagaatctttgtctctatttttagtattgtttagttcctaaagaaagtaaagcaatataaagtataatgcattttaaacagcgaagtcagaaaaataagaaaatgctcaaaaaggaagattatttaaaatgtaattcgcacaaaacacgtataatgttattcacttaaattgctgtatttaacctagcaatgtaattaaatacgatatcagatcaaagttttactttaaaaacttttaaaatgttactaaaaagaaagtttacagctacccacttcacagctttgaaaatttccataaagcatttaatctattaaataggaaaaaaaatgactcactttcaaatatttaagcatatagaataatggaactaatatgcttaagtgatttacagatatattttagaaccttgtatatttaagggattattccttaaagtttaatccaacagctgtggagcaaatatacctgccaggcattatctaagagcaatacgatgagaaatacgggtttccatgtcttgggtatttccaacttagtgtagtgataaacaataaacaactattgtattgggaaccatttggagcatagtaaatataaatataaataggatttatttcacatactaaatagaattataagtagaactaagtttgataggatggaggaatgtcaggtgcttcatagatgacatgggccttgtgttggtattcaagaatgacaagaatgaaaaggtgcggaaaaattcacgagataagcaatattcttatcagcagattctgattgttacactttttttgttgaaataaaacagggcaaaatgcctattttcaccttcatgtttgtttcacattaatgtttcacattaatgtcttttggcgacatgaaattgcattcatttcatcattgattcaacaaatatttattgagcacttgctcagtgtcatctatggggctgcagcatgggagtcacaggaaggcagggttatcagtagtgctgagtctccagaggtcaaacaagggaaggattccaaagcttttgttggatttgctcatagatcatcgatggccttgacaggagtaaaatcagttaattggtggggccaaatccaagactgcagtggatggacatgtaaatggggagtgagaaagttatgaatagagactattctttcaaggaatttgacagtgaaatgcagaaaattgaaaaaaaaaaaaaaatcaaccacaggcctgcagagctgcaagtagcatcctcaggaaatcctactggtctgaactgacaaactaaaaatggaaaaaatcagcttgctttttacaataacacattaatctaaacacaatcgttgtatctcagtattgtggaagtgctttgtgttgtggctatgtttttaagtgcctgtgatataaaaccacatgtgctgaaaactccatctgctctgcagtgagattttctaaatcagagtaataaaaacgatgaagagccaaacgtacactaaattggaatgaaatgccatttgtaaaaataaattctttgtaaataatataatataattaacattggaagtttcaatccatgagtaaatgtgcccattagttgcagttaaagaagcttgtgccttatccaggatgactgttaagcaaatgcatattaaagattattttatttaccaccttcccattccaggtagctttatctttccatctgaagaaagtcacaaggctctctatatgattattttggtacattagcatttttatggggaagaacattaatcatatgtcactctaaaataaatgagagtaggcgatgcctcatttctcttgaaaagcgtactcaaatttgggtcaggtttattcttgggaagtactggacacacatatttcagcacctacgacagaacctgtttcttagaaatctagagtattgattttagccaacggggtatctttgtatcttcaaatctcatagaacttagagtttacggtggggccgggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaaaaaaaaaaaaaaaaaagaacttagagtttacactcaattggcccttagcatgcatatatatacacacacacgtatatgtatatttttttctgaatgtgtcatgtgtataactcatgtctccttaaccaaattgtaagttagttgcataaatcagtgtcaatatcacaactgaagaaaggtggcacgttcaaaagggagtaattcaaggagtttaagctatgaaggggccccttatcatgaacaaggtaaatgccacaaccgtggcttgtaatgatttagccattaacagccaaagggggaaggggacacagcagtcacctgaaactaggagagaatgctatacaatttttacagaaatagaagcagtggcttttggttgggcgaagccaaactcacataatttggatgcatgggagataagaaaataaattccacgcacccacttcctcccttcatttgattcgccagggtttcatagtggtcatacccaagaaaaagtcaaagaacataagaatattcttattattcaaattaaaagctagtgtcccaggaaaagaagtacataaaatctcatctgctattgtttcattgcaggatggtattagtcctgttatatatctgaaatctgtaaacatagccaccacttgtatttttcatagaaggttgtggagaaatgcccccattaataataataataaaaacttattatgtgatcttagttagtaattacagttgccttcttccaatgttcatttcttttacttttactttctgtcaggatgctacagaggttatttaacaggtggatcaggccaaaatttcattcctgccaaatgttactcctttccatccttttctatttttttttttctttgacagagtcttgctctgttgcccaagctggagtgcagtggcacgatcccggctcactgcaaactccagctcccaggttcaagagattctcctgccccagccacctgagtaactggcattacaggtgcccaccacgcccagctaattttttttttttttttttttttttttttagtagagatgcggtttcgctatgttggccaggctggtctctaacccctgacttcaggtgatccgcccacctcggcctcccaaagtgttgtgattacaggtgtgagccactgcacttggccccatccttttgttaattatgttgttacaatttcagttttccatcgaccagtactattgggcaaaaatgtatttgtgactctcctgagttccaaatgtatttctccttgccctcctttgcacagcaaacatatttttatttctggcagatgaggaccatcatcagacccagcttagtaactgtgttttgtctttttttgggggagttgcataatgagcccacaatggtggggagaaaatttccgtttccaattcagaggaatagaattatgactatattcctggtggataccctcgtcctttaggcaatggacttctaaactcaccaacttcaatattatgggaataagaagcaaattgtgttctgtgggttattgctgtgataataaaagataacactactacttctaccccttagtgcctagatctgtacctcatggctatacaggtggggcacactgcatgttaaaggatgacatcccggcttcaaggttattgctaaacaaatagtgccaaaactgaggtagagcagactattttactcctctatcaatccaagtacatatagctagtggggaacatgataaaattagtaaataccaccactgagcccatggtgcttttttgccacaaaatatttccttttttgagataaggtaatgtggattattatggtaatggataaatgtttctgtaaagagtagtgctgaacagatccattggcagcaaaagcaaatccatgcccagaatatgtgtgtatctctgtgatgacaaaatgctacactgtcttgatggaaaggttttcatataattcatgtgccttcctcattacattatctcaaaaaaggaaatattttgtggcaaaaaattcacgtgccatcagctcttcccctgagaagtgatcctatgtcaaaggctcagcgatggccactaccattggcaggtaatggtgggagccagaggctgacggacatgtacttggcagtcatcttgtcctaaatttttcccctttctagtaagtcgattcacttgtttttcctaaacctccctgtcactagttttctaattttacttttgccacatccctgataggtggacccttattagttactgcacttgagtcaggatgtttccatgcctgaaactaagtctcctaccacgaacagtggacaacgaagtattctgttcaaaatcttaccaactgggaagatttctgtttcttattgtctttcagtgccactcctgagtcagattctagtatggagcctacccaattccagctcgttgttgtacatcctgcagacctgccataaaccaggcccgcgtttatttctcccttgccaacttgtgttagaaaacatgctttgtggcacagatgtgagatgaggagaggggatgaagcagagaaggcaatacaatgggcaatcacatttgttttctggctcaatttcacttttattttatagtggaatggtgtgtgtgtgttcagttctatggtcagtggatcagatagccatcagttcatgatgggcagtttgggttgcatactcacttggtatcccatggtgaggctaaatgtttctcctggagccctggaaagagctgcccttgaaatagataatatttttcagtacaagcgacaatgatcttttttcaaatcttgtaatgcctgtcctatgattgtcatatggagagtcccaaaggctccacacagcatctctatttgccatgggcactgacattgccattggatctgctggagtcacaaggttcaggacatagaggaggttgcaacatggcctagatcagttgcaaggccccctggtacactgattctactcagaactagcagttttacagcttgcctgggatatagaacagagaacatatgtcaatgcggcttgtgttgttttcaaagtccaaagaattcaattcctctttacttttacataagtacaattgtaacaaattttctctgactttagaagagatatcccggtgtatcccaaactactagatttctagaaacatccccggtgttgcacacttttaaattttaaagaaatttgtctccctttctctacctctatgcagaggagttctagttccctaggatagcggttgcctctgtcagcaagaagatttgtcagaattttgatgttcaatatcttcagccataaaattaaccacatacagcagcattcaaccataatgtgttatttataagattggccaagaaatcataactatactgtatgcttttgtccaaacattcttatcctgtgtgttggggtcccaatccatcgttatgaatatctttgtcttaccctaaaagagcaaatggagttgagcctctaatatgtattgcagccgtgtacccgttcctatgttctcttggactgtggccatagtttccctgcaactacagaagagatggactcttccaaagataccatcgtgacctttggttttgcatgggcattcctgatttcacaatcatggtttcaagctttcttttttcctgtgtactatctgtggggtgtcagaagaaccatgcgaacttgtttcctaatctttacatcatcattgttgtagcaagtaagtgctacaacacttacttgctataactagagatgctgtgtggagcctttgccactctccatatgacaatcataggacaggcattacaagatttgaaaaaagaccattgtcacttgtattgaaaaatattacctatttcaacaagcatttgttctcccaatgccttttccctctacctgtattttattccatgtcaccaccactgatgattgattactcacagttccgtctcttgctatggattgtctatgctccaattcccacttgagaaggtgataaattccatttgtatatatagatagagagatgacaaatgtagtctcaacatctaattttgagggtctcttctgagtctgctgctattattaacttctgtatctgtcagagtcccaagtgttggcacattcaacaagatgctttgaagataattgatttacaaagtgaacattttattgtctttttatttacaaggagaacatttgctgaggttaaggggtaggaaaaccacaaaggaaagtgatgtaaactaagctagtagcagccaagttgttagcactcctatgaccatgaagatgagccattactagacacataaggagaaatttgtgtagaggtggctgcagtgacagaagtagtgacatcatttaaagttcacagccagcctgaggtaacattgtaggatagagccaagagaataaataacctgactttactctcctctttctaatctcctgccaaagggaagccagaggacatgggggccattttgatgtcgttcatataggttagctttctggaccagaaagcgggaatcaaaaaagtggatagtggatcttgaattaaatgaaagatacccagtatacttcttattccattttcttagagcttaaaatagtttgatgaatctagtgggccctcagtttggttgatgatggtagaatgcaaatatgattacatgcaaatgtgaatgaatcatgacatggatatggttttaggccacatctcactcttcaatcaccgttctcattctgattactccagtagtgctttcatctgttctgtctacattgctgaaaatccatgaaatcctgacttaggtgcttcattgtttccttcctctacagctgcttgctcttcctggaattaaaagggtgactcagaattagagaattttcagggaagttaataaaattcaatacacagtctagaaaatataggtgtacaatggagatttcaaggacagatgtttgtgggtcactgagcccacatctctacagttggtctcaaataacactcatttattctagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggtaagtaacatggaagtactattttgttccttctctctctctgcactagtgacttgacagatggtattcttggttcttgaacaagttgtctttggaggaaaacagaagttttccttacttgtcagactcatcactttcgatctcccagtagtctatacacagtgcttgggtagagagaggtagagatgatttgaaagtgtgtgaactttcacttttgttgcatttctttccttttgatgctcacttttattttttcacaccttacagttgaaaggggagagagaagcaattgggggtgtactgaggccagggcaatgttttgtccaaggcctattccataataggtgttacaaaggaggggaaagtgccatggtcaaatacattggaagttcttaaaaaaaaatctagcttctttcagatgatttcttagagcacttaatgtgctatatgttaatgtatattataaatcttctataaaaaatagactatgcataaagaatctccagtctgaaatagattaagcataaagaatctcaataaagaaaggaccaagtataaaaaaatcacccataaagaatagactaagcagaaagcatttattagtattagtatcaatatcagcattaccttggcagagcatactctagaacacactatataaaatgctggtatggagtcatagccatggttaggtaagacagatggaatttttcatcaggtgaagaaatatggcaatatgttccagacagcaaaactattttcaagtgttgggcaaggcctctataagagggttgcaaaaacatctggattgtactgttttttcctctgtatgccatctttaattgctcgagatctcttttaaacatgtattttttcccaatgtttatataacaaagaagaaggctcatgtgtaaggcccccagtatattaatcatgtaaagaagtcttatgggaaacgtgtaaaatttctcttctcattttagctcctaattaagtaagagaggatgttgatctcatttagaagccatttttaagccatttctttagtgagttgtactttgtctttttcaagcacaataggttttctgccgtttaattcatgcactacattagttagacaaactactgggtaggttcccatcaccctcattactctagccctgtcagggtgggggtgaggtcatttacactttccttctgttcccaccagccaccatattcattttatccaaaggcaaaaaaaggaggcttgaatattgaggatcagaaataaaatgagcatattcctcagtgagatttctcatccatgttccttccacaggttgtagtattaaatgcaagattataaagagtatgattccatgattttaaaatgtgatttatagggtcttctctggacatagattagaaagcagatatactcagtgctttttaggagaacataatgatttaacttcacaaaaaaaaaatactaagagatttttattgtactcaaagaaaagaacttctgctttctccaattatagatttagctttttttttttttggcatgacagtttggacctatacagcataccagcactattttttcccccagagaaaacctgaaaagttgccccaaatatattaattctcacattgtttgatttatgataataaatgttcacctgacaatttaaatgtgaaatggagaactagtgacatactgtgaaaggcacattcaactgttcagtgcactgcacaaagggaatacaatcacatctgactgctcaacgcactgcacaaagaaaattcagtcagttctgtggaagggacaactgtttgtaactgatttcccaaaagaaatgggatttttttttattcacatagtaaaaccaaatgcattgctgcatgctcaaattgccttcttagttctagactcatggtgcttgaacttggccatgcctaggcctcataattttgactagattgagacaaacaaacaaaccaatgggagcatttgaggaaattaaattatgtcagcaataattcagaagatactggatatgaacctagatactttatcatttgataatgtcttctaataaattaatattgcttaatagtaaagataggcgtaacataataatctttgtttattaattgtagaaatcacaggtactaatgataaactttatgttttcagggagactttccacttgtttgtttttttcttatttggtctttatcacaattgtctcaattttacaaatgagcaaatagattctgaaaggcttagtgcttttatacaagtcacagttattttaagaacagggaaaaaactcaaatctattgatttcatccctctctataaaactcccacaggtcaacaatttgtatttccaaaaacacagctggaatccaaacatctccttgtcaagttaacatatacatatggagctctgtttgctccatttactcctaatgacttagctacatgtgggtgccattcttagcctcaaacctgtcattttatatatatgcaaataatatgtataactatatatgataactaccattaatatttattagaagtaaaaaacatatgcctctaataggcaaagccaaaagaaagaatttccagtcctcaggtgatttttagtaggaagacctgctcacctacccaggtacttaagacaataggactctaagaaaataatctgttttggtccttgttcttaaaacaaatttcagtatcattttgggtatgttacgtcaattttcagattttttattatctactctggtttcaaaaaatgttttgttagtttttgctgtaacaaatgtattgtttcaattcactcttatgtgataaactttcaaaaagtgccactttggaaactgaaacaacacatagagtttatactaaattgtgctttaaattaaactagatgaaaatgagtatagcaaatacctaatgtggtcagatttactaatgaaatacagtaaacaaatatatttgtattttacttaattcagcatgattcagaactcataaaataccctatcattagcaattcagcacaaaacagatgcacggttctatcccagtaacctcaggttaatctttgtaattaaaacattatcttgtttaatgacaatctagttgccagtaaaataaggttaattgttattgaggcttgtgtttcagaataatagaggggagaaatttgtggatttgcagtcttcatggcaaatgtaactgtaaaaagcaaatagatgaaaaccctccaatctgcaaactcttgaaattattcaaatattaaaatttacaaatgaacttgcgatgtgtgcttaatttcaaaactccatggaaagatacaaatctgtgattagagaatgctggactgttgaattttggaggcagcctaacgcttagttgagatgttcacgttttgtctgaaaactggccacattgtgtgcacaatttttactttgtgataagcttatagcgctgctgacataaagaaaactgccttaaagatgataactgatacgtctttaagaaagtatgccataaaactgtgcatcattggtaagaattcacagaaagatctaatttaatttaatttcccgcttgctttaatcagtgtatctaatgataaaaaatagaagcacagcttttcactaactggaagatttaatgtcttaacaataattatcattttaattcactaccatatactattttaggcactttacataaatctttttattagtttatgagatattcttatctacagacaggaaaccttcaactcaaaatttctgatttgtgacatattctcaaagaagtgtttgtctcatttttgacaaaataagacaaataaaatgatacttgagaatctttagcatgtgctcataaccatgccaagtaaataacagactgaacatttggactcaggtttcatggacttacacattaagctaagcctgttctcgaaatgtggtcctttcaccagcatcatagggcatcagcttcatgctggaggtggactgccttcagcagtcagtagcttaagaagcccctcaggacctctgaatgattgcgatgctgtctaacttttgaccaccactgagctgttacatagatagatgcataaatagataaagatacagataaaggtcaatgttttattaaaatttgcacactcactatctgggaattttgtaaaaacagatttgtaggcccacactgagagattctaattccaagtctgaatataggtttcaggtggggtccatgaatgcgttgctcaggttccaggagatgctgattgatgctacggtccaagaacaacactttgaatggcactgccaatactgtgtcaggctgtaaagttcaacatacgagacccagctagagaaatggtaggctggtaggctaaaaattgaatagattaaggccgttattttgagggagaaacatgacaactaaattaaaacaagaatgatgtgaaagagagctcataagagtcacagaaggctaaactgcccaaaaaatgttcccgggcactgttgggcttgggagtaatgaaaagatttgcaaattctgatccagaacctttggcgtgcgggaggctcatagcttatcttccaggaagccctttactctatgaaccaatttcataatctctcttaacagttacctcatttccatagtggaaacctttcctgacttctttctttggctcaaaacttctaacctgtgaatgatgtacttccacagatgtgctagtctcttttgatatccaacaaaacatttattgaggaactcctgctggctactgttggcatatattatgttgattctggtcctgatttaactatgggttttgtcaatgccaattccttaaacatggatcttcgtcatttttaaatcagttttattccctttaggttgtttattggattttttaattcaactcacatttaatttcctttttcttttctatatatctcatgtggacttctttaagcatcagccacatcataaggataatggcatattgtttagaaacatattaagtaccttattggtacttaatggcatattaagtctaaacttaatggcatattaagtttagaaacatttggtacctcattgatggggttattcatttattcattccaattgcttgaaatatgtcatgaaagttctcattcctgccccttactcacagtgtatttggcaaaactttgaaggccattgtgttggaacaaacagaaagcgcaatattcgcattgtagttaagaacatcctgggtttaaatactaactttctcagttttaggtatttcacgttgcactgtttgcttagattctccattgtgaccaagagaatgtttatatcttacgactgtagtagggacatttaatttaataatttgtgcaatgcctttagtgcctactatgtgccagaaacgtaccaactactatgcctgctagttattatttatttaatgaagtgttgattcactgaactcaaattaaattatccttgctatccttgcctttctgttcttcatgccaggtactcagtgaggacagtctgcccatggcccacctcccaagggttgtcaattatgcaaatgagtcaccccatttagtaattagtaatgtttaaaaggaaagcccgggagattaatgcgatagcatacattacggttttggaattttaagcacagggcacctggttttggtaggcgtctttctttctttcctttctatttttcttcatttctcctctttttttttaattagccaaaccttcttcccattgcatttcatatcctctaatgtgaataactacttgatctactagtttgtttgtttgtttgtttgtttgtttgtacagccagcccttctggtgccattttagggaaagaacacagaagcactgcctaatgagtgaagtcatcacgatttcctatcacctttaattgtctgaagaaaatgattgagaagcagcaatcttcaaaaacaattgagggcaatcatgttgtcgaatttaaaatcatttctacttcagagaaattaaactttttttcttttctaacacaaaacagtaaatgaatcaaaaatccttttcttttttacccaatatattctaatgcttaatgtacttgcaatacaactttcattttctcaaaggcaggtcaagtgaacccaacaataaaattatatgttgtaaacctgtatggaccaactcacactttggagctcatgccacctgacagctttaaatcaaggtatgcaatttcaatttcacttttatggggaaatagatattttcactccaattatcattttgttgcaatttagagagagatgtgatcagctcaacaaatccacttgaaaataaagctgaagttgcctacattagtgaggaatgaagtcattctcggtctctggctgttcctaggaagcatttagctccaaggtgattatcagcaccatacaatgactgaagaggctgatactgagaattaggtcttttgctggagatgtgacagagatgggaacaaaagatcattttccactgaattttcttcaagaaaatagttgctccacattttttttgaaggtgttcattaaaagtgtataatctctctggaatttgtgagtttttccaactttctccccatagttttgccaaagattctctagctttcttctccagacatttaagaatttttttttcaaaatatcctatgtatgaaatacttatatttaagaaacttgatcagggagaaagtaaacacattttattgggtcagaagcataattgtaatattagcaaaatcttcagtagtgaacaactaattaaataatcatgtgtattttgaaatccatcatggtttcagacttcaaaagtgattctttcaaatactagagtcctttggaaatttatcacaaccctagagatgggataggcagctgatttagaaaaatgttttcacattatattgaatgatgtggggataagttcaaagtttattttgatgatatcgataatcagggtgattggttcccacagaaatttcattcaaatgttgtttcattgacattatttagaaaaaatttcatcccagttggtcattttcacagagagtgcagcctgatgtgtgtggaaattttacgtacttgaaaaggtaataaaggtttatggaatgcttactccagaagaccctcattaactacctaatataaacttctccttctactgatggaaaagataaatcccagtgagagtaaatgatttagattaggggctcaggactcattgataagaaaagtagaaaatgaagtaaggactctttcatcaggttacagagcatttcatccacgttggatggaagaccttaataataggcctgaattggcatataatgtaatacagttgaccaaatcaaatagtaacatttatttctgagcttgatctagcagccatgaatggttacgttacaaatgaaacaatgatggatactattgacattttatctggtccttaactcttatctttttctctggtttgtttaatgctatggaataacagaaaagggaaatagactaggagtgcttgagtcacatgtctaccaccatttcatttgtctcattggataaatcactttacctctctcagggctgaatccccttgtcttttttttttttttcttgagatggagtctcactctgtcacccaggctggagttcaatggcacaatctcggctcactacaagctccgcctcccaggttcacgccattctcttgcctcagcctactgaatagctgggagtacaggcacctgccaccacgcccagctaattttttgaatttttagtagagatggggtttcactgtgttagccaggatggtctcaatctcttgacctcgtgatccgcccgccttggcctcccaaaatgccgggattacaggcatgagccactgtggctggccccgcttgtcttgaaataaaatttctaatttttttcctttcaaaaaaagtttgcaatgggaatcaaatttacaatatccatgtttctttctaaaaggagctcttgattcctgaccttgattttttttacctatttgtataaatataaacatatataaattgaattattaataacatactttcttcatgtcctattaagttaatcaaatgtcctctcttctctttgatgtttgtgttgtgttcatagtatagctacctgtacagtttaaaatactgcctaaactctcaatagcagaatatttaaataattcattttataataatttacatgtttatgggttttttttttttagtatgttacttaagcatctggtatatttttataatctttaggttatctgtgaattgacagccaataagtgaatcatattatgtttctcagtacagttataaactatcatttttttcttttttagtacttttttccaccacacctaaaccacaaatatgatcatctcttagttttcttgtcttaataaaatcgccaaaatgactacaataataattgaatacatatatgattatgtctatataaggaggaataatagtaagataaatatagaaagatttttttcatgacttccactaccttataaaccagattctctgacctccacactggagaacaacatttttttgttgtttgaattgaagatcttaggtcctttttttggtctgtctgattgcttatttggatgattggtttccttatttataataactagtgtttatcactgtaatagaaaaagttccccaagctagtatcattatcccttcaacccaatacttatactcaccaaagactgtaaaatacattttaattaatttatatgatttagaaagaaattaaaaggataagataatctacagaaagacataatttcttctcctaattcttaccctcatagtctcttcaattgttttatttatttatgtctgattcagctgaagtcatttcatcaatttagacaatgagtgcaacttttcctcaataataattcagttcagactcatctcatcaccattcagtttatctttacctgaatcacagtctgtattgattctgaaaagaatgtagcatggtaggaactaagataatgcccctttttgaatatccccagaactagtgggagttggatgggttatctcatcttggaaggaagaaacattttgtcaaattgttgtactgtgcacttaaggtattgcaatcacacaatacctttattagaaaatttaagtgtgaattttaaaatatatatttactttccagggaaattttatcttatgataatgaatcatgaagattttccacagattggataagtcacattaatttggagaagtgatacgtggtcatttgtgtagacctctctagtctgaagagtaaaagtaatgatttgtccttggtttcttcttactctatgtccttagcattattttacttcttagaaatctttctgtagtcacttatcttttgtgacccattgttctcaacctgcatcactgatttaacatggtcattttgcccctgtgactctgggcttgacactgtcatgctttctctccctatttctttaagtatatctagcctacatctcttactcttccaaggagtatctgtgccttccaagaaaatctaattaataaattaacccatgttcatggaagtgtcctgaataacccttctgacaagtaatgcatagttattaacagaggtctttgtagaacgctagctataatttggtcatgaataccatcacaatatacttatgggaagacatcacagattatctagaagaaaatgagctcaaagtaactacaccgcacaaatattttggtgtaaacacagagcaatgattggacaggaaggccatgaaaacacggtgtaactgctaacatacctgtctgcaggtgatgctggggcctccattccacataaccttgtgtacaattagatcttctgtgccagaccacccagctgatagaaagtctgttgacttgagtgcaatccctctaactagcttgtctctgtctctgtggctcaagaggaccagatcctcgaggacttcctgggtaatccagagccatggagactaggaacaagcaggaaacccagttataagaaagggacacttctgctggccactggtcgtggaacaccagatctaatgtgttcatgagatggagttccaggaggacagctacatctgcagcaggcaggccaacgagtgtgacatttccaggtaagggtgcttccctactccctcattcagagacagcctgaatacttatgagtaagcaagatcagtcaatatgaatcacagggagatgtacacctaggctcctggggcaaggaaagaaaggatataggaagtgattgagttaatagatatatctttcctccctgcctatgtgtcaagctctacttgagcttccattttggctatctccaacaccttcatatagaaatttcagtggtttgaaatggtcgtttgttagactttaccaattaaaatttgtggagagctttcattcttcagattgtgtttaccatgtgcaaggtcattcttgggtataagcaaggtttgtaatgaggtatctcacatcagattatgctttgcttatgaccgtaagccacattatttaaaaacagacacaataatcacaatatttaatcaaagagaactataagtatattgctgtaaattaatgattttcaagttaacagtttacaactaagttagtgttcccttaaaaatcagttattcaccacatttgtactcgttggcttttcattcttttccaaagattaagttcttttttttaagtcaaaatttggcatcttagctaataaatatattctgtcatgcctgtgaggtgttgcaaagatgttcttgtagcatttcatttgagaccaactttgaaaaggaaagctctcaagatgaatgtttaaattctgttttgttgttggtggtatttatttttaaaattattcatgttagtttgttacctcatattgcacaaaatataatattatggcaggtaattgagacaaatttctgattatattagaaaagcaactatatatcagttcaatatagagtttaccaaaaaatatgaccttcttgattttgcagtctttggttagttgtttacaatattcaaattaattttttacttcaaatttcaacaacatttatatcaattattcagcatttcagcacttattttctgattatttatagtacttactatcatttttctataaactaaattctctagaaaaatctattaaaggttaatacttcattttctactttttaatattcacattgctaaatataatggtgtatgcaaaataatcggcttaaacgaaacacagtgaaagtgaacaggacactgttctttgcaggatcacaaggcctattgatatggacaaagattatacctaagccagctgcatatttgattcaatgttgccttattaactctacttcgggcactttatgttttgatttcactgagtttaaaggcagttttcaagcagagctcagctagttgtggcagctgccagatgtcttgaagaaattgttgaaaaaaatattacagccttccttgtatgtcaagttatgcttgcccttctactgacatcttcactttgataggctaacaggttttctagaggaaacagtagctactcggtaatgttagatatgtaacattcatgtagttgtatatctaacccagatacctctaaagacaggcaatttgtatcaagaggttatttttctgtagttgatatttttctaagtcatataaaactgggttaattaactgtgttttttttttgttgtttttttttttttgagacagagtcttgctctgtcgcccaggctgtagggcagtggcacgatctcggctcactgcaacctctgcctcccaggttcaagtgattctccagcttcagcctcccgagtagctgggattataggcatgtgccacaacacccggctaattttttgtatttttaatagagacagggttttaccatgttagccaggatggtctccatctgctgacgtcgtgatccacacgccttggcctcccaaagtgctgggattacaggcataagtcactgcacctggccaaaactagtttaattagttttaatacagtacattgatgacactttccgtgacacgtggatggctgtttcttctgagatcagatgagattgggcatgttcaggatggtatggctgtagactggatggctatttctaaagtaactgatctgttctgaaactgggcaagtttttagagaagtttttttaagtttttatcataaatggatgagtattgatgattgcattttgttgcgtgtgagttggaagctttgtgacatattgtatacctgtccaaatgtatgtgttacaaaggaagatatataaactttccaatcaccagttaccatgaggacataattggccccataaattatatctttattataccaagaatttaatagactcccatcttctttaatttgattcatttcttgtttaaaaatgtttcaaataaataagataattaacaatatggaaaaaattatgtattaaaaattgggactggtccttggtctacaactggcaaagaccaaaacaaaccattcataccttggtagccaaagtccccacgtatgaagtgaaataacacagaggttatgtataaaggatataattattaagccaggaataatctttgccttttaactggaagagattattcttgatgattcattgattgtgattttaaagaaaaaaataacatacctttataaatgtatacttgttttgcacttaaaggagtactaatcaatagaaaattttcataaatatctagcatgtcattgttttgatttttccaagaaatacttttctgggaaataattcactctcaaatttgttctcaaattatctgtatatttgtatacatatgtatacatccatgtgaatacatacatacacatatatttgtatttatatatgtaaatattgaaaagagcagatatctatttatctatctatctatacataaattaatatgtagcaacatccttatagtggttcagttattcttatatataaaatggcaaatgtatattgttggtactatatcaatgctctggctctaaacatacattttaattttgtttccaaactagagaatactatatcactatggttaaatgggtaagcaataccaagactgtggtaagatggttaaaccgagctcagaacatctccatcctcacagtctgtgagaccactacaggtgcttgtagtaaagtgagtataatttatttttcttttatgcctaaaatgaagtagcttatgcagctttacaaaggggaaacaggaaatgctttgtacaaaaaaaattcagtgtttaacttttaaaactaataggaaaagaattattctattaagaatatatactttaatttataaagcttccaaactttgaagtgaacaatattgatgataagcagaagagaacaaactgagcttttgaaaaccaaattaatttttatacagcatgaagtataatccaagccacgttagcttctttctcagatatggaatttttctccatattttgtctttgattatcttgagaatataagaagtttctttcctatcttctttaaacatattccttttaattttttctgtagttcagatagatctgataaaataacagtgtttctgtactgaaattaagtaaaacaagtaaaaaattggttcatgaactactctgttttgaaatcaggttatatttcaattcttaataccagtttttgtaaactctgtggtaaattcaatgtgtcatttttaagattcctggtagagaaaacactgcagtaagtttaaacggttatgtgtatggtatttgggtaaagcgtttttagattaacaactgaattttcaaacttctgttctggaaaagatggagtacgtgttacctgactagcttttctgttataaacaactgtaaaattgtacaaaatatacaaaacatctgttttcagatatgggacattaggaggatcatgaccataaatgctgaaatcaagtaaatgcacaaaatcaaccttgctatgactttctattcacaacacttttgagaccaaatggcaaggagatggagcccaagcaaagcaaaaagatttttgtgatctaagcagacagggagaaccagcgtttgaggctttttttggtgactagcatttataggacagggaccagagaagttggagctttatagaaaaggactccagcaatctatggagaggaccccttaagtattaggctcaatgcttagctgtgcatacctatatgtttccacactgtcttaaagaaaacaactactaaaaatttttgaagcaaatgaagaatctgcaagttgcaaagtacttagagacgttagagttctgaacaacaatagtgaagagatctccctgaaaaccctgggtattcaactgagaacccagaaagaaagcacattagaagtagggctagtctagacaccttctaatcacctttcaattacactgtaaggtatcaagttcatctgtctgtaaattaactgtctactaggacaaagtgtacatttttaaaggggaaattacaattgataaagactatcaacaatgtagcatttataatgtcaatcatatgatcaatactatatatgtagaaaagtggaaaatataacctactcaccttcctcaaaaatatccagtaaaagctgacctacaaaggatagtaatattggaattagcagacacatgttttacaagttattagaaatgataaatgttggaagtgatggatatcttaaatacactgatttgattattgcaccttgtatacaggtatcaaaatatcacatgtactccaaaatatgtatgattattatgtatcaataaaaaattaaaaatcaaggtaaaagttaagtacagtgaagtgaagaaatctcacatgtgcagttaaatgagttttggcaaatgcatatatcccgtaattcacacctcatcatgatataaaacatccctattatcccagaaagtttctttgtcctctttttcaatcagtctcagttcccagaggcaactactattctgaggtctattataaattagtttcgcatgtttttaaactgcatataaatgcatttatacaataacaaagttattagaaataaatctaacaacttagaatagctccaataaataaacaggtggaaattttagtggagaaataaactttaaaatgaaactaaaatttcaggaactgaaaaatacaatgtttgaaatgaaaacattgaatagacaattcagaaataaatacatgtgtttatagtgaactgattttcaacaaatgcatcagaacagatattagggaaaggacagcctctttagtaaatattgctggaaaactggatgtcaatgtgcagaaaaatgaaactagatgtgtatctctcaccatatacaaaattcaactcaaaatgaattaaaaactgaaccgtaatttccaaagctataaaactactagaagaaaacagagaaaatgcttaaggacattggtctaggcaaagattttatggctaagacttcaaaagcacagacaacaaaaagaaatgtaaattggtactgctattatggaaaacagtatggaggtttctcaaaaaactaaaactataattaacatatgttactagcaattctactactgggcatttatccgaaacaaaggaaattagtatatgaaatacacacctgcatctgatgtttactgcagctgtgctcataatagtagggatgtagaatcaacctaaatgttcatcaataaatgaatggatttttaaaaaagcatacatatatactttttaaaaagtatatatgtatgcttttttaaaaagtgtgtgtgtgtgtatatatatacataaaacattccattgtacatatacaatggaatactattcagccataaaaaagaatgaaattctgtcattcatggcaacatggataagtctggaggacgttatgttaactgagataagcgagtcaacacaaagataaatatcacatgctcttacgtctatctgggggataaaagaaattgcacttatagaagtagagagtagcattgtgcttataagagtctgaaaagcttgggaggaaaggatagagagaagttagttaacagatacattacagctagataagaggattaagttctagtgttctgaagcactgaaggttgaatgtggttaataatgatttagtgtttattttcaaatagctagaaaagagaatgttgaatgtttaaagcacataaaaaatgataaatgtttgaggtagtggatatattaattatcctgactttgtcattacacattttttacatgtatcaaaatagcactctgtatttataaatatatacagtaattacatgtcaactaaaaataaaaggaaaatacatcaccaaagtgaatgtatgaagaggaagaatatttgaataattttacatcaattaaagataaaaataaagaatgaattaaagataaatttatttagtaaattacataaatttaattcataattagaaaccttgccacaaggagaactctagaagcgggtggattgcatgatggattctatcaattattaaggaataaatcctgtaattccttgtcttggtttgttttgtgctgccataacaacctaccacaggctgggtagtttataatgaacagaaacttattgactcacagttttggaggctgggaaattcaagatcgagaggttggcatctggtgagggacttcttgctgcatcatcccatgacagaagggcaaagagagggtgagagagagagaaacaaaaggaggctgaactcgtccttttataaggagcccactcctgtgataacaaacctactcccataataaagacattaatccattaatgatggcagaaccctcatggcctaaatactccgtaagattttacctcttaatactgttgcaatcacacaatcacaattaaattttaacatgattccggagtggggagcaaatattcaaacactgtatcattctttctaaggagtatatgataacatccctgtactccttagaaagtgaagaagaaagagaacatttcaactaatattataagagtagaataatactgataccacaactagacaagaaaaatacaagagacaacattttagactgatctctctcattaacacgtgtaatagtctgttttcatgctgctgataaagacataccgagactgggcaatttccaaaaaaaaataataataataaggtttattagacttacagttctgcatgtctggggaggcctcacaatcatggcagaaggcagagaggaagaagtcacatcttatgtgggtggcaggaggcaaagagcttgtgcagggaaactcccactgtaaatccatcaaatctcatgagactcattcactatcatgagaacagcaaaggaaagattcgcccccgtaattcaatcaccttccaccgggcttctcccacagccatgggaattgtgagagttacaattcaagatgtgatttgggtgggacacagccaaatcatatcagcacaaatatgagaaagtccttaaacatatcaatactcaactccagcaatataaatagaggatagtgcattgagatcaaatgaggttaatcccaggaacttaagattggtttaatattgaaaaccaatcaatataatatattaagaaaaaaagaagaattaaatatcttggtagatgaagaaaaagcaattgacaatattcaaaaccaattcacgataactttcaatataaatgaataacaagaaacatccccaatctattaaaagatactcataaagtacccccttactgaatgtgcaaacactcaccttattcatgttaagattagcagtgagataagggtatccattctcagtactatcaagcaaactttaccagaggccccactcagagtaatttagcaaggaatcagtatagtgttaggaaaggaagaagtaaatctgtatttatagataacataactgtatacattaacaaaaaagcctacaaaaaaccctagaatacaaaatcacaatttgtaaggatgcaaatggggtaaaatataaacaagtggcaagtaagtccagagggcattcaggtttctcaaaccagtcttctaacttttgtctataagtttgtacttgtttcaaaataaagaatgaagaaacaacaaaacataatttctaaatgttagtgatattaagaaaaaaaatcagttaaaataccactaaaacccttaaaactttaaatacacaattataaacttaacaaatattgtgaaataccccaatactgaatactacaacattgctaaaaggcatttgaaagacctaaataaatggaagctattccatgtttttaaatagaaaaaattaatattgttaagatattaattctacccaaatttaaccataattttaatataataccaattaaagtcccttctgattttttttgtagaaacagacaagctgtttttaaaattaatatggaaacaaaaaatacctgaacaagtcaaagtaatcctgtaaaagaataaaattgaaggagttagccctacctgatttcaagaataaataaaaagctacaaaaacctggagatgctagtggaggcataaggaccacaaataggtcaactaaattgaatggtttgcagagaacagacccacatttatatgattgattgattttctacacaggtgctaaagcagttcaatggagaaaaatggtgctgaaaaaattggcatcccgattggataaaaaaaattgatgtttgacaactcatatcatattctaaaatcaatttgggataaatcatagccctaaatttaagagctaatactgtcagtgttctaggggaaaatatgaaataaaaccttactatactgaataagccaaaaaatcattaattatgaaacaataaattggacatcaataaaattagaaacttctcatcaaagacaccattagggaaaaggatatgcaaactacagtctggaagaaaatattttgccaaatgggtatcagacaaaaacacatataaagaaattctataactcaataataaaaacacaacctcataaaaacatcaaaacatgtgaacagttacttataaggaaaagaatgaacatatgaaaaagtactcaacatttggtcaggtatggtggctcatccttgtaattttagttatttgggaggctgacatgagaggatcttttgagccaagagttcaagaccagcctggacaacaaaatgagatcccatttctatataaaaaaaaaaaaataaaagcactcaacttcattagacattagcaaaatatagattaaaattataatggtatattatacataattagaatgactacactaaaataacaaaaaactgacaacattaactgttaaagaggacgtgaaaaacaaaaattctcgttctttgcaagtgggaatgtaaaatgatatgattacattaaaataatattttagttccaaatgaagttaaacatatgtaaacacaatttttttgtttatatataaataagaagacatatatacacacacacatatatatacacatatacattcatatataaaaacacattataggctgggcacggtggctcatgcctgtaatcccaacactttgggaggcggaggcgggcagatcacctgaggtcaggagttcgagaccagcctgactaacatggagaaaccccgtccctactaaaaatacaaaattaaccgggcatgttggcgcatgcctgtaatcccagctactccagaggctgaggcagagaattgcttgaacctgggaagtggaggttgctgtgagccaagatcattccatttcactccagtctgggcaacaagagtgaaactccgtcacaaaaaaaaaatacaaaaaacaaacaaaaaaaaacccatacattataattccattacaaagtatttgcacaagaaatgaaaacatgtgttcaccaaaggatttgtaagaaatagtctgtagagaagctttatttacaatagctaaaaagtagagactatttaattgtccactaacaggaaatagactttaaagtaagacttatctacacaatggaattctacttggccatagaaacaaaatactgatacgctcaacaatatgagcgaatctcaaaaacaagtggtgtggaagaaacctcacactacagagtacataataggtatgtaatgcatgatttcaattatctgattttctaacacaggcatatgctgtctatggggaaaaagatcagaagtgattgccttttgagaacctctggggaggagcatgagttaatgttttggggaaaaataaagatcctataacttgatgggataaacttgtcaaactcatcacattatacacttaaaatctgtgcatttcactatatgtgaaaaatttaaaacatattatttaaatggtctgtgaaggagagccctcaagaggcagacatttctctttgagtagaatgatgagcatagtcgtggaaatgagatagttaaatcaaccacttgatgctcttctcattaagcttgtattactagaaaattcatctctttcttttggctagattatagattgactagaatttctccacgtatttgttaaagtgttctggatggtttttattcggctgattagtaagtcatttaaaaattggcctacaggccggctgtggtggctcatgcttgtaatcccagcactttgggaggccagtgtgggcagatcacctgaggccaggagtttgagaccagcctggccaacatggtgaaaccctgtctctactaaaactacaaaaattagccgggcatggtggcacacgcctgtaataccagctactcaggatgctgaggcaggagaattgcttgaacttgggaggcagaggtttcagtgagccgagatcgggccactgcactccagcctgggcaacaaagcaagactttgtctcaaaaaaaaaaaaaaaaaaaaaggcacaggccaggcataggtagctcacacctgttattccaacactttgggaggccaagtggggagaatggcttgaggctgagttcaagacctacctgggcaacataatgagacaccatcttatttttacataaaaaattaaagtaaaaatttaaaaattagcctacatatattgtagttagagaaagcccttctagacaaagatactgtaaatatttcattgcatacagataactgcaaagataaattaaaatgctttaatagaaaatagatccagtaatcctatcatactattgatctgacaccttattgatattgtattttattctacgtatggagataaaaagactttgcattctgttaattgaaataatgagacaaacaataacaaatgaagttttgagctctcaggggttctaccaaaacttggtggtactaacaagcagtggcattggtatctattttatttctgtgctttacagatatcaagaatggttaatgctagggtgtaaatggagaataaagaaatgattcagttagattttttttgatatcttcacgtaatgaagatctattgaaaaaaaaagtgccctgaaaagagaaagtgaccaattataatgtaatcataatatggatttagaaaaagaaattagtatttaaaaacatataaataatttattattaacaatttgagatgggtacctctgcatataggaaagcccctaatatgttgttacttatctttcttaatttgaatacgtttattatagaatcatttctttcagaaaactgcaagatatttcatgtcattacatgtaaacggtattattaaagcttgttttttctacacatatttaacgaggttaaattagtctaattttgctttttgcaatatgattttggctctgatctactgcaagactgttttgaagggacacataattttgtcatttcaaatgtttgatattttttctcaaagactgagttactactgataagaaaaaaagaaggccatgattatgagtgaattgaatattgaaagaatgtccactttttagttttattcctggctgtttgcccagttgctttgaaggacttaataattttgtctcccaatgatgcctagaggtgaaaagagacagtgtctggtggttcaaaacagttgaatgaggtaatcaaacagagctggaaaatgatcttctctccctggtgaggtactgctgggaattctgaaagaattcaccaaagaaaagactttataattaaattatcgtttagtccctattctctacttactcattcagattaaatcaataatgacaatgaaatctctcatggtgtttcaccagttgaagagagggaaaaaaaactgataaccgtgttttaaaaaagttaaatttatatatgctcattttggtctttagatgcttcatggagttaattgttttgtttcagaaatatgagatgacatcagatacgtggctctctcagcaggtacagtataggtggtctgtcacatcttggccattgtgaccatcctgttcacccattttttatgtgataactttctgtaaaaagtatgagtttaaggctttgctaggtttgacagagtgatcctttttcattaaaaggatcacttatgacttgggctttctatggtatcatttgtgaaaaggttacttccatttttttaggagacataaattgcagagtagctgccaggatcactttttaaaatattctgtgtaagtacactcttgtgtagatgaaggagaaaaactcaggacctaaccaaactagaaatcattagcattgttcaaattgtctgaaaaattgacctgacctttacataaattgatcatggagatattcaaataaatacttctcttcttagttgtattctagctcacaattctagtttgtgacataaatgaggctggaatcaagatgaacatgacggactaaaaacctaatcactgttacatggtctcatcctggacaattcagaaggaaacaacacaaatagcttatttaaatatagctgaattcattttactcttaactacattagtgagttttgcaaagggaaataagatgtgtggtatggtttggtttggttttctttttgttctttaaagccctcttttattttatattacgtctatggcgttaatgaccacccatattttgagaccttcacatttatccagacacttcagtgagttctgaaatatccaaatttatgcttgccatctcctcctaaatctgtaaaagtagcttcatactccccaggtctaagctgaactcattccttttctagtcagtcttcttaatttttatcttaggactcaatgacataattatccattcagatgttaaaactatttacctaatagtcatccttgaatcttttctcatttttatctatctatatataattaatatgtacagattttactttcaaacatctctcaagtcaatttacttttctctaattcacaaacactgtccatgttcgaactacagatccagcaagtctcaacccctcaggcacctgccaatctgttcacactgcaggctaactgagtgacctttttaaaatatgcatttaattgttgctactaacattcccctcatacttgcacttccacaactcaaagaacttttctctcttctttctgtccttcagataaagaccaacatccttaaaaggtccacaagggattaattgaaagctttttcagctctgagtcatagaatcatttgatctgttttctccagtctagctacatggaccctcatatgcacagggacttcataagtgcccttccttctgaacaaaattccctcaaactttcttatatgaagcctatttatttttcaaaccttggcttaaatcacctatgtaagaagtcacttcctctaactagcctaaccaaatcacatctcccaataaaagttatattaaagtcaagtgtaatctttgtgtaacacacaattattgctatgatttttttttttgctaagatacaaggacatgaggatgttttttacttctaattgtaaaccaaacgcctagtatagaattcaatatgtaagaattcaatatgtaagaagagcttaatagatacttactgagtgattaagaagaaaagtaaaaaggattataaataattgtttgtctgaagggtaggtagatggatagacacagataaatgtttgtatatatattacgagtatatgtgtctttgcacatggttatctattaatataaatacttttatcttggtcaatgtacaaaataaaatagaaaaaaaaccctgattttacagctaataatagactcacaaatttcggttagatacagaaaataagaacaatggacaatatataacacataatacttatgcattctgaatttccctccattattaaacatcttttgctattactttgattgccagtgacattcataatagtttaacatatgtcaacataatgcatgttcttttgagattatgctatctaatttttaaatcccaaatttatgaatgtttaatagaaacttttttaaaaaacaaagcatccagttattaattattcagttagtaaatgccattggtcgtttatcacagttgatttttttcttcagatgctctaagggaattttatgaaatacttagagttatatgaaatttaatgtatgagcatggtagcagtaataagaagcagcaaatttctaagataattataaatttaatagaatcatcatatactgtctttttgcatagcagaaaaggcaaagagaagtaggcatgtttagcctagctttcaaaggacttgcaattgagatgaccagtgtgtaatatatttggtcaagggaatagagtccaatatccccagcttaccatcttgtgtgtcaaaaacactgacttgtataatgtcatgaaactgagcagtgagattggcaccatctgtgtggagctgaatgtttatcaccagacattgtcaagtgttgggggcagattttttagtccagcaaggcatatgagattgtagcccccatctattccttttctgaactacttctaaggtactagaactggggaggaggcaatgtaaatggaagaatgcttatatatctgtatatgagaaaaaagctattcatcttttgatagaagtacaaagggagaacggtaagggaggagttgctatgtgggggtaaatctggtggatagagtgatatataaaactaatatttttgttcatggtatccatatattcatctattcaccaattatgagttgggacctactgtgtcttaggcaatagagctaaacagataacatttaaaatttagttcaattattaattgcctagtgaaggaagccaacaagttaatagatcaatataatagagtgcattggaagccatgataaagatgaaaacaagatagtttttagaatatctgaggagagatttcctaactagggaaatcttggaaattcttttgtttcatgagaataagtaaaaaatgagtaagatttagcagaaaaaggaagacgaaaaagttgttccagacaaaagaaactccaagagagaaatatcccacaggagcaggtgatggaacaaatagaattattgactttattatagttgaaagaagtgattcactcagtcaagtattttgtcagtatccattatatgctcagttatacaatttttccaaccttgaatggtatattatctcagagttttaaatttattacatatgttacttatattttcatgaatgttcataaggcagttaaggaaaatatccttattttactgtcaagagatgtattgtgaatgaagctaaaatcaaactgttcagtatattaaaatagttattaattgactgattcattcagtaaataattattgagctcaatttacatgatagtcactgtttcaggtgctgcagatgcagtagtgaaaaatacaagtttcctgccctatggggcttacattacagagaactacatacatacatacatacataagtatgtaaatatgagattagtgcaaaagtaattgaggtttttgccattacacggtaggtcgcaactcataattgatgaatagatgaatgtatggatacaatgaacaaaaatactcattatatatatgtgtgtgtgtgtgtgtgtgtgtgtatatatatatatatgtatatatatatgtatatatatatatatatcactctatccaccagatttacccccaccattaaaagtaatggaaaaaacctcaattaattttgcaccaatctcatacatacatttatatacagtatgtacatatgtacatacattcatatacatattttgccattaagagtaatggtaaaaaccacaattacttttgcaccagtctcatacatacatacattcatatacaaacaaacgcatacatacacaaattatacgttgaatggtgttagttgctgtattagtccattcttgtactgctataagagaccaggtaatgtatgaagaaaagaagtctaattggctcacagtactgcaggctgtacagaagcatagtagttattgcttctagggaggcctcagaaagcttccagtcatggcggaaggcaaatggggagcaacacttcacgtggcctgagaagaagcaagaaagggatgggggaggtgttatacacttttaaacaaccaggtcttgtaataactcattcactcactgtcatgagacagcacccagcggttactgctaaaccattcgtgaaggactcacccccgtgatccagtcacctcccaccaggccccagctccaacactggggatttcaatacgacatgagatttgggtggtacacagatccaaactatatcaggtgctatggaaaactagaaagaaaataaaaggagatgaaggatgtcagatagagttggatggtctgactttcctgatctcgctttatatagggtaataaggaaacaccttattgataaggagatttcggattagagacctgaaagagataagaggaagatccagaccaagggaatacaaagtacaagagccctggagcaggatcatgcaggaacccagtgaagaaagcaagagaatgacaaagatgagatcagaaagacagtagagggccaagtcatctaaaagggcttgaaggccattgtgcagagctactcaggacccatatcaaagcctttctttataccatatataaccacctctcgttagtccagcaggaaaaactcaatgtttcatcagataaatgtgttttcttaatgtttttcctgaagaaagagcagtatctctctctctctacatacatatatgtgtgtgtgtgtgtgtatatatatatacacatagtgtgtgtgtatatatatacataaatatatatagtgtgtgtatatatacacacacataaatatatagtgtgtgtgtgtatatatatatgtggctttcatcatttaattttcaaaaataattctattgatttaatgtgccaccagagtgtaattaaaaattatcaaatggggtcacagttgtaggtgggcatttgtgtttgtgtgtttgtggagagatgagcaataaggatggtaaatttgaattaaataactttctatagaatcctttcaatttcgtggcctgtcgtcttttgtattttcagttaatttatgaatacattatcagaaaagaatcttcaagtaagtacagttgctgaagaaaggatttcaaaaaatatgttacagaattttgtaattaaaagatttattttgataaactgatgcagatgtttgcatgttctttatctttgaaggatatttcactaaacacaatcttatgtgaagatatgacagttcttgtttgaaccaatttaaaaagtgtctttagtctgataataaatcattcatatccaccatgcacaaatttctcctatccttcccacaactcaaccacatacatatgtaatgtatcagatttactttaaaaaagtttaaaaaatagcatacattcatttttttaaaataatgtgcccattttcctaactaattataaatcaatatttggtataacccatgcaggaattaacagtagtaggcagcacagattgcatgtgcctttctgagattgttctgtgctcttctgtattttagaatgaggagcccgtgttttctagagacggcagcaaattctttatgacagtgcctgttaagcaagggggacgtggagaatttcaccacgtagctatgttcctcatccaggtaagtgctggcttttttccatgttttgatttcattgtcctcatgtccccgaaggcccagttcttgtggcattctaaacctctagttcatggtggtgaaacccagccatatatacaactcacagacatcttaggaagaggacctccatccatagccatacattcaagccttaccttcccacaaaacagtctcaacactcagtacaatttaatgagttacatgtgtgtcctatgaactgagggctttgggatagagaatttaataaattaaaagcacccaacttttgaggacctgagataatctagagaagattttttattcaatgaacatatatataacctattttgtacaagtaatattctccaggtgttataaaagttttaaatactcaaaggaacctaaatgtccatcaaaaattgatggttgaataaattatggcacatccccacaagcaaatacagtgcagatttttaaaaaacaggataaaatagatgttttatgttaaataacatagatttcatgttgtaaaatataatctatgttttttttttagactttccgataaaaagaggggaaaggttactttttatctaatcaaaagaatatgaagggtttatacagttttattataaaaaaattagtaaattcaggtagttagtttaaatttgacaaggttattgagtcaatctgaatttaatttccaagagcaagcatacatgagaaaataaagcatccttcaaaatcatataataaataatctagtctcacacacaggttaaaggctttctaatgaaaagtcactgtggctaaactgggatcttcatgagtgttttacaaactagctaagagtaatttcatacttacaaaatatagaataaatataaatatggcaaagatacctaactgaccttactaattttatgtttttagaacctttaagacctgtgcacattctcaaatgattaccattatccatatacatttgtattggacagcttaatgctttagagtctcaaaatcttatgtcactaatttaaaatttaaaacttgttcagggtctgtgtaattaaaatagttgtcattgttttaactttaattttaattacgactgaaagaaataatttggaatacatacaatttccacagtacagatgtagattgattttcatagtatattattaaggtggaaaaacaggttataaactaatgtataatgtgatcctatttatgctctaaataaatgcatttatagatgcatttatatatgcatttatagatgaataaaattttggatgtttttatatctagctattaaaatgattatataagtcaggtataattaagggaactttttttatgaaactgaaaggaaatagactagcaaattactttactttataaacttttgctaattaagagtcaacttggttatcacaaatattagagaactattttggcccctaaaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtgtttactttgttcctcttctatatagggactataacacagccttcattgaagtagaaaacattttttttctattctggttgctgtttaggtaatttgtggtttgcctcattgagaaatgaacatgactgcatgattatttatgaatattttggcaattgattaaaattagtctactttgctaatgagtcagaagtcagtgctaggtaaatacaatttatacataactttgaacacacacaaacacaatcacatatgttattttaggaaatggtttgaatcaccttgcctcaatttaaaaatagctaacaaaaaagctatttatgaattgtgtatgactgcttaattgacatatatgcactataaaattctgaaaaattcaaacttaataaactgataaaggagtatataaaaatcacccacaatatcatcacctcatattctcacacttttaatccattattgtgtatattttacattcttttttcatgagaaatatatgattttcccctaaagattgcaattaaagcataatatagatttgtaacattaaaagaataactaatgagtgttttcttacaacatttaattgtattcctaatatttaacattttatatttttcttaaatgtgattttaatagctgctcagcattacagcaagcagatatactgtactgtatttatttatttatttatttatttatttattttttgagacagagtctcagtttgttgcccaggctagaatgcagtgacacgatctcggctcactgcaaccccctcctcccaggttcaagccattctcctgcctcagcctcccgagtagctgggattacaggcacccgccatcatgcctggctaatttttgtatttttagtagaggcgggtttcaccgtgttgcccaggctggtctcgaacttctgacatcaggtgatccacctgcttcagcctcccaaactgctgggattacaggcataagccaccacgcccggcctgtactgtatttaaatgatccaagtttattcatcattaaagttatttctatattttgatgttagaaatgattcagagttaaaagcccttataaacactttacttataattcttcccgcaaaattatatttctagatgttaaaagatacccaggcagggtatatccatacgaatgtatttgtttaggttttgatgtgtaatgccaaattggctctccaaaaaatagtacaaaaatttactgcctaaacagtaatgcatgccagcattgatgactttttaccccctttccttcccttgctgtgctacatgattctacttaaagttgtcgtgcctgaaaagtgagaaatgacaggactggggccttggcagccaacagtcagccaggtcacctttgcagtacttggcgcttacctatgtttgagagcttactagttcactcagaatatatttatttgcttgaagtaccttactaaatgaaattactaaatttttgcaaacattttgctctctcatattatcagtaagtagataaaaatcattaattagagaccaagctagacaattattgatttcaagctattttcattatggagagtgatggcggtcactacatatattttagtgggtttttttttttcctcatttacaagagctgtccttgttaaagtgattccaaaggatacaaataaaaagagaaaagaatgcatgtgttttcctccagtcttcatttaaacattattgtaattttatgtaaactacagtattgcatcctgatatgtcaaatttaaattttaaatgcacacttttcccacaatgctaaataattttgaaaaataattctttagaagattaatattgagttgactggatgtgcatcaataaccattatttgttgttctgtgtttaatttagtggcaatttgttgtaatgatagatgtcactgtatataaagcttatttatattgtggattatttctttagtattgattaacaaaactggaatagctggaccaaaagtaaaagatttctaagccctaatatatgtatttccagatcactttcagtatgaatatatgaaagcaaaatttgtgagtgttttctccactttcatatattccattaaagaaaatattaaataaaactatggcttttctggaaatctatatagctaaagaaactgttcttctggatagagtgttttgtacacgtattactatcagtttatgtacttcctgagtcatacactgatacaaaaccttttaccccagaccattaaacttttgatcacttcagatattcgcccctttgccccttgaaaaatatttgttatgttgacttcaaacttctgaattctcatctcaggaactgtaacattctacatcctgcaattcaggctgcagtgaagagataggtttttatcaaaggtatagcacctttttctctcaaagatggagtaagcagaattttcattgtgttcagtcgttcagattcataggcgtaaggaatggccctgtcaccttctaaaattgtgttaaatgaaaaattatatgtgggtgaatccattcactttctctattcagcaacacgaagttttgcccatgagagctgatgatttcacttggaacgattttaagtggcattattcactacaaatactgtggaaaacagcatgcccccaatccacaattttatcacctaatcaacccagtaaaatttttgcattaagtttcactgctgcatctgattaggacattgtctgaaaacaatgagctcatctcatgtggtgaatagatggcaaattaaagcatgctatttttaagcactacaatatttcccttatttagaaactataaaagtgaacatttaatataagaaatgtgaatgaataatgtgtaattaggtaaaaagaacatgcagggttaaacttgtattgatacccaatgtgtttccaatttgtaaatcgcattataaaaccaatatttaacttccttgagcaagataaaatctctatgaattgaaggtcacttgtctggtgtctaatgctccaaataaacactctattccaaatttccagccctcttttaagaatgaatgagctcacgacttttgttgctttttagtctgaaattaaagttgaaatattagttcaatttaaaatacattgtcatactgcctttatcaaaagtctactacagttttatatttatattcagtatttctattctaccaagttaatattgcagagattatggattcacagaaacaaagaaatgttattgtagagaaaaaatgctgttctttcctgctttgttaagtgatctttcctgtgattgcatttctgctgaaggtgcttaaaaacctaactgaagtacaaacatccccttgtgaaatctgctcaaatactgtgatatttattaagtgttgttcagtcatctaccatattctgattggtattaagattattagccaggtcaaaattaatgtgctcactgctgtgacagtcttatgtagattattagaaagtaaatctttgctattatatgcaaaatgagggttcaacttgttccccataccatatttgccctggtagattaaaagcaagcaaggcaattacagctgtttcaaataaaatcaaaaggttatatggttgttattaaggcttccaacaagagatcttttggtcctacacttgaaagtgtaatattttgaactaaaaggatcattgaagtaaatcatatataatattttttatactgtgttcaaacatttttcaaagcattgggtttttactcatggcaattttaatgttgtatctcatttgtctttaaaacacacatacacacacacacacacacacacacacacacaccaaaatactctgaaaaacagagaaaataattaacctagaaatctgtgggccaaaagtgtctccagatgttttcaaatattgagcaaagtttcttcacttttttaatgttttgagattattttatcttgaaattggcatcaaagatgcactaaaaccttgaaattttagtatcctgtccttggctcattcaaagcagggcctggaaacaagaaagaggagctatccactgagttatttgcctgtgtgaacttggcaataaaatgtatgactttagaactctgtgccagcctttgggttatgcagttctcatatctcacaaattgggtgtctttgcacttatacctctagtcaacaaatacttgtaaatcagtagtacgtcagatagtatacaaagaagttgatataaagaagtcacaggcttgctgttgaccttaagcagctagacgtctagagaacttccactaagaacataaaatagactacttagggagatattgaaatgcaaatacataccaataagacagaaaatttttcaaaggaagattctgttagtacacatgtgcagtaaagtatggaatgcccttttagtttacactttcagttgtgtgggaaaatagatgttataataaaactatcctatatgaacctaattctgaatttatttttaccaaaaatgcattgaaagcattactcagctgacagattacactctctgaagacaatgaaattgaattgcacaaataacaacatttaaaaggttatacatttggaaacaaaatataatttctattcatagtttcaagaagaaatcagcaaacacttagaactaaatgagaatactacatatacgaaaatatgcaatacatataaacaacagtttttaatatatgcaataattttatatgcatatatgaaattatgtatatatccaatgtcagaatttagaaaaggaagagaataaattcaaatgtaaaagaaaggtaattagaaatgaaagaatagcacttattaatctagtaagcaaacatgaaataaagcagtatgataaaacaaatagtaagttatttggaaaaagtagttgaatctataagagctgtcaagggtaataataacttggacagttccaaagtataaataatggaaagggacaaaactacagattttaaaaatattaaaagaatactatgaataactttacattgataaacttgaagtttaggagaaatggatgcaatctagaaaaaaaaatcaaatcagatttaagaaacaatcaaaatcctccatagtgttaagaaaatggaatcagtgatgtaggattttccacatcagggaaaggttgtttttaaaagtgaatctcaccaaatattctaggagtacgcacttccaattttatattattttgaaaatgaaaaaatatggcatgtctttagtacaatttatgacatgggtatcatcttgtaaccaacacgaaattaaaacagtatcagaaaagacagtataagaaagcttaaaaatactaaaccaattattgacaagttgacttatttaatgcatttaaaaaattaactcttattttttgaacagaaatgcaaaatttacttaaaatttcaaaaatatgtaagataattaactgcatttaaattttcctgagaaaattataatcaccttaatagatgcagacataggatccaagtaaattcaacaaaatcagtattcaaaaaccttagaaatttaggaataaagggaacttctttaaggtgatgaaggcacttgccaaaagctttattcatatagcataattgataatggagcagtagtaatattccctttaaaatcagcactgagataaggaatcagagtgaagtagcttgagtatacacaacactagagataacagttgtttttgtttttagctgttgttgttttatacttgaagctctggggtacatgtgcagaaggtgcaggtgtgttacataggtatacacgtgccatggtggtttgctgcacccatcaacccgtcatctacattaggtatttctcctaatgctatccctcccctagcccccaacctcctgacaggcgccattgttcagctcccacttatgagtgagaacatgcagtgtttggttttctgttcttgtgttactttgctaagaatgatggtttccagcttcatccatgtccctgcaaaggacatgaactcatcctttttttacggctgcatagtagtccatggtgtatatgtgccacattttctttatccagtctatcattgatgggtatttgggttggttccaaatctttctaatccattctaatcagtgttctctaactacataaagtggttaaggaatagaatgatagtatttctaagaatactttttgggtcaaacaatatatattttttagacaatactactacctgttttttacatattaaaatgttggtcctataaacaccttggaagcattgattaagctaattaccttcatcaacatgaattcatctctgaaaaaaaattattgcattaaatggcaaatcttataacaatgcccatactgcaaaggttaaaatgaatacaaacctgagtatttattggagtaaagtttgttctaaaatgttttttttttttaaagctaactgtacagctgccagtcatttacatgagagtgattaaagtcctaccttggaagcaaatgctgccatcaacatggtatacttgattcaccctcacctggaggagttttctgaatgacttttctatagttgaaatgaaggcactaacctacctgccttgatctgtgtttataggaatgcatgttcattcttgagctgtggaacagaaaactgagtgttaactgagaattagagaattcgaagtgtcacaagcagttggtacattcgtgtttaccagagagatgctgtttaaatgaaaggaaaatcaatattttctatttctttgcagagtaaaagtgagcaaattaccgtgcggcatctgacatcaggaaactgggaagtgataaagatcttggcatacgatgaaactactcaaaaaatgtgagtgttttcagttctctagtcaggctgcaagttagcgttgtcaaatgccatcttttctaatagaattatgttttgcttaccatagtcctagtcaaaacaagccagccatggaaagaataacctttctttaaagacctcttccacacttcacacagagacatcttacacagagggatgtgtgtgtgcacacgcacacacacacacatatactcacacacagtgattgagagaggttatgaaaaaggatgattttatcaggggaaaaaaatatgtttcctagtttgatcatagccctgtgtttgtatagcaaaacaactcctgtctgtattttgacagttttaaaaattcaagtgaagatttaatgtgaaaattcaggtgaagattcaatgtgaattcaggattcaatgtgacaatgtgacaaaattcacagatcacaaaaaatagatctgtgtctaatgcttgtgttgttttctttcctggacagttactttctgagcactgaatcttctcccagaggaaggcagctgtacaggtaagcagtgtgcaaggatctccttacacagattggcttctcaatggctatctatgtagcataaggaaggaaaggaaaaatttgaaatgtctttttcaacatggctaggaagagccaactttgctgacaaagcttcacactcttgcaccagtctctcccttgacaggactggagaaaatggagccctgcttgctccttcctgctctgcagcctccttattcttttcttcacctgcttttgcagtttcttaatatcttttttgtggcttatttctctcaactctccacatcagagagatttacgtattttccctcgtgccttcatcttctgctaagtctcattttgaattttcagtgcattaatgtggcacaggtgaaatttattcttgtacaatataatgttgttgtgaacagttagtctagtgtatcaagcaggaagctttccctctttgtcttgttgttcataaaacccagtgagattgttgcaggaggaggcatccttatttaaataaggaacgctcattgcttgctaaaataaagcaatataggggaaaataattacatttgttcaatttcccaaatgcaaaactatactcaaaaaaaggcttaagctcacacctatttagtattaaaatgtctcctcactcagagagctttcaccaggatctcacaaaaatgacttttatttttggctggcaagcaacctattaattctagactttatatacatgttctaatttccatttcacagatccatttttaaagtgtcaaaactgccatgacatattctcaggggaaattcatcatgttttaagaagtgtcaccactaattcttaccgagtagtactgactttcctttgagagtaaaaatgcatgcttaaagtaccccgacttcctctgcatcacccccacactcttatttatacacaatttgctttcatcagaagcaaccttgtccttttaatcgcctttcttaatacatcattattataagtttattctcgtggacctcctggaacgcatgttcttaattctgacttccaggaagcaaagctattcatatagagatagtgatttgaattttggattcgggatcttgatcaaagtactggtcactttttcttttggtgacctaaagcttatctttcttgaaacatacattatgattgatatcggtagccataaactgtagcttagagagatagaaacactttatatcttataaaactctcattttataaaactcaaagaaaaatgacagcatcagaagattagacttggtcaagttcagcaaatggaactgcctcaatctttcttcccattattagtgtaaaatgtgatttgaatcataatgacttcttagatttgtgtgcttgtcttatctctctagtgactgaggcagaacagtcaatgtatctctgacatgtactagtgtagtcgacagtgttacaaagaaaatgtagtagcaataaattttcccttaaatagctcatcaaatgccagttggcttgactgtaagataatgttagtgtttgacccagaaaatgcaatcaatgtcttgcccaggctataaaaatgatcactggttgacttaatatatggcactaggcacccctgcaggagtaggactgctaccgtagtcattgttactttctttgtctcaaaatttgtgtctctttatttcagcaatctcataatctaaataatgagaaaataccacataaatctccagggagcttggatctaaaagctttatggaagagtagagagaaaaaggttttaaatcttagtatgtcactgaatagctgtatgcaactgggatactttctaagcttttctgtggtgaaaattgtacaatgttgtgaatgtaattaatgaaactgaattgtacacttagaaatgcttaaaatgacaaatgttatgttatacaggtttaacccaaattttataaaatgaaaaaaaatggctatggatattttataagttatcatgagtgaaactaatatgatttgtgcttggtatatattgttttgagtattataaggaaatttttggattgtaatcatctcacagtgtttcaaatatggaattgtgattttgtgaactgtttcttgtagctgccttaacacccctgttccaatccccatacctacagcgtattgcacatcaaaatcaacgtgaatattgttcatttgtaaatatacgaccaaaaatcatgtttcattccaaaatgaaattgagaccttttgtctgatcaagtttttctaaaggtattctcaacagtgttttcatccattgacctaccaaattttgcattcagacttatttattaaataaacaatttgataaatgaaatttaatcttatattaatttttcaactcctgtaaccttaagcaccactattgtaaaataaagatggtgatgactcttctttttaccacctcattatgtcaaagtgtgtattgttgttagtgttatatgtgttataatacaaatgtaacttttttaaaatcagtaatttttctgcaagtaaatgatggggaaaatttggcactgataccaaattctaatgtttagaatgtttaatttagaaaatcatgagctggatttttttgtttgacttgtggaaatgcatattccttctttcaattagtatgtattaaacattgaataatctctgtgggaaattccctttaagactttacacagaaatatctattaaaaatgcaaaaaacagtaagttaatttgagttccattgaaatcagttctttgtttatagccatacatacaagtgtacatattacatacataaaataatacataattttaattttaatagattaagaaaaatgtgtatgttttaacattactaatagaaggtgactttttatgtatatggtgattcatagtttacagtgaacctctatgcaagcaccgatgtaactcccttgtttatattatatttaaatatgaacaccacacattcaagtgcctagaatagtagcatttctataataacttcctttttctttctccagtgcttctactgaaggattattgaatcgccaatgcatttcatgtaatttcatgaaagaacaatgtacatattttgatgccagttttagtcccatgaatcaacatttcttattattctgtgaaggtaagataatacatgaattctgatataatatattttattcattgtatttggtcaatatctgttggtatcagcaactattactctagatgatttcataatcttaatttataaatttttgttaataggatatacattatatatagacttactgagatacaattttttacatattttgtatagaaataaaaaatgagaataagtcaataaacatgcacacataattaataagtgctatttgaacatgagcaactttaaaaggtgaataaatatatttacatcagcgaggccatgccacaatcataaactaatttacctagtcttcagaaaaagtaatagtctagtcttctttttaaaacaatgctttggttgttaagagatttaggatctatggaaatttaggacctgtggaaattgaattcccctgcttcagagttcttcagttctgatcaattacattcaccattattacttcttctatcttgtaacaatatgcgtagtcttacatgtttatacagtatctctacaatatattcatagaaatcattttccttttaatatggtactgtattttccagagattaaatagaactcatgtgtcctcttataatatgaagagttgagtgctactactgcagctgatatattaagctgtccttttttaagagacaatgagagatataccaagacttactttttgacattgtttttctcttgatatatgaaatgaagtaatcaaaaaagaagtccttgtttaatgacaccaggaaaaaaaaattagttttagatgggattccttagagaagtgaagtttcaagataactttttacagtaacaaattagctagtgtattttaaatatttgaagattatggttaacgtatttttaaattaatatatagttaccacccaattttaaacttttcttatggatgaactatttccaatatgcgtgctttctttttttggctgagtggcaaatagaatttgatcttggatcagtggatgaggggtgaaagggttgtgaatcagctttgtgaacatcagtggctagtctataaaagactagagataaagagaaagcatgtagaattggctaaaaacatagaaatatagaacatttgggggaagagagaatcttaacaataatctctgcaaatagtttccttctcatatattcttacccttctgaataaaacgcttataaataggaatgaaagctagttatctggtttctgttttgttatgttttaaccacgaagtgcttccatttggggggaaaaaactattatgtaaactttctaatgattattacttagacatctttaaaaatatttatacacatatttttaaattccaggtccaagggtcccagtggtcagcctacatagtacggacaacccagcaagtgagtacacaagaagacaattaagaatagttatggttggcattagtcttagacatcgtgttatctattctgagtcatatcctctataaattcttcttcaaaaaatccccaccatgaggaaagctgcgtgtataccatcaacttgaccttatgtatgtaagagaaacagtaaagcaagagatatgagccatgttacaggtgggaggtgaatcttatatgcccgaaataggatatctactacctaagtcaaatagagttattgatgaaacaggtacattttagcttactggcctcttaatgttctggttcattcttgcctgggcctcacataagttattcctccagaataaccttttgaagacatttcagaaaattatgaaaaatgtgttattttatatattttctatcctgtttgttccagatatccaggttcttctagttttgtatatgcactttttcatttatgaatttattcatttgtatatttgttaggtttgttaagagatcacctacttttgtcaaacaatgtgacagagtcggagggtacactgaaagagtgttttgttcaagaacttacagtaaagtagataaataaatgcatggttgagcttatcttaaaaatgaataaccagatttcatcctgccttcctttctctttcctttcttccatgtttgtatccttctttcattttttaagttttatttaatcaatgcttctattctgtgatgatttcacataagctactataatctaataatggctcatatttattgactcacttgaactttggaatacctctgagatagttaatttgattatccctttttacaggtgagaaaaattagtctcaaagaggttaagtggtaataacttggccagagtcatactaataaatggcagaaccagggatcaaatgagacagtctgactcgagaataggtttataattcactacaatataataactactttttctattgtgcttttgcctcatgcattgcatactcttatttaagtaggagtcagttaggtggcttgacttagaagatatataggtaaaaaagtgtaaggttgaatgacaaatatcattttgagaaaacagaccaagaccatttatattgttcaaataatgtcatatagacacttagtgcatgcccgaggcaacaagaaatttctaaatttgtgttgggtttttgtgtggctgaaagatggtttagcacacattttagtttctatttatttcattatttccgtcttcagtgtaaaccttaaaaagattatgttaagcaaatcaaatatattcaatattaactctaacggcaacaataatgaccatagacagtacggttgataaaatggaaagaaggttgaatctcatagatagaactatcagtgtataaaataagtctatcacatgctttttgtgggatccaagacagtgcgttaacatctcaaaacatcagtgtcctccgagacaaataaacaaatgtgtttgcagtgaagatgagtaacattcatgacatataggacacacttaatcaataactatttgtgttacactgtatatcttgcctttaacaaaggatgattaaaaattttccaatctgattttaatttaattttatcctgttgttacaaggcaatgtcttttctaataacttctgctgcaaattacaaaacatttctgtctaagggaaatcatgttattttcctgttcaaaagccaatcatgtttgtctcaaggtcaacaaaaacaaaaaaaggctgtgaatagtggtcaagtgcttaattttcttttcaaaagataattacttagggagataaaatttatagtcaatggcaagtaaatctttgggtcaatgaaagcaaatataccaatgagtaagtcataactcatttttgggccacatgaagtagaatagtgcatggagagaaaattttaaaaaagaaaaaggaaaatatttaacaagcatggaaaacctttaaacccactagttatcaaagaaacgcagaagaaactactgccatgtaatttttcctaacaaattaataacattaaaaatttacattactaataaagatagaatgtggtagaaatgttaattataacatattaaaaataatagtcaaaacttatttcttttgtttttttgagacagaatttcactcttgttgcccaggctggaatgcaatggtgtgatctcagctcaccgcaacctccacctcccaggttcaagcaattctcctgcctcagccccccgagtagctgggattacaggcatgcatcaccacgcccagctaattttgtatttttagtagagacggggtttctccagttggtcaggctggtctcgaactcacaacctcaggtgatctgccagccacagcctcccaaagtgctgagattacagccatgagccaccatgcctagcagaaacttaattcttttatatcattttttcatttttgtagtttacactgagaaaataattctaaatggagaatattatgacaaagctattgaaaatagaaaaagacattataaataacaaataatgggagtttgtaagtacattttaatggaatattactcagtgccctgggcatcttccatctgtttttccagaaccacttttaactctcaattcttctcttcgatgttctctggcctagaagtactttctatagatgacttaggttctgttgccccatggcttccaactggattcaaccaaaggaaatcttgtaggcaactggaaagagggagaaaactgctctgggttgtttattccaccagccgtgttcctatggagtcaccacaggttggctgtgacctttggctgaagggaatcttcacccttgaccttcaggcccagccactgttttcttgaagttttctcttttcactgtgtttctgccaggttttggtatcagaatcatgctgacctcatagaatgagttgggtaggaatcccttccccttgattttttggattagcttcagtaggattagtagcagctcttctttatacatttcatagaatttgaatatggatccatctggttccagcctttttctagttggtaggctttttattactcatttaatttcataaatcattatcggtctgttcagggtttcaatttctccctggtccactcttgaaagggtgtgtatgtccaggaatttatcaacttcttgtacgttttttagtttgtgggcatagcggcactcataatagtctctgaaggctttttgtatttccatggggtcagtggtaatgtcccctttgtcatttctgattgtgtttatttgacttttctctcttttttcttaggctatgtagcagtctattaattgtatttatactttcgaagaaccaacttttggtttttatgctttttcacgtattcatttcattcagttcagctctgatgtgggttttttttttttcttcctcctgtagctttgggattgatttgctcttgtttttctagtttctctgagtgaatattcaccattttttaagcatttaaaattaaatgcttaggatagcttctttggaaatacactaatgtttaaataatcagagtttctttccattttaaacatgtaaaaaacctcttagaacatctagtcttccagatatatataataggggaagatatttacttacaaaagaggtagtttgatgtgcctgaggttacacatagacagcgtagtccaatgggagaaacataaaattacatgcttataacagtctatgattatttctctagtaaaagtgcacacagttcaggacaagaggaagtcaatgagaagacattttcagaaaaacgaatgtgtgtatacaaacataagaacgcataaaagtgttcacatttgcaagataaacattgttcatcatagctggaacaaaacatttactaaaagagcaaaactatatgaggccagaggggcagactggaattggattataactcttatgttttctaagtagtttggattcaatcatatttgttcaatgataaacctttgacattttattttattttttttctggccatggagtaactggaaatagacctgattcccttgtttcctttaataataataaaaaaaaagagtaaagaaaactggacaaaatatacaaatcaactgtttccagacattcaacaatagccagcatgggtctctgatccctgaaagaaggaaacaagtacaattagtgttgtaagttctctggctttcttgttaatagaaatttctgaactccaatgcaataaggaataagctaatcataatacaatgatatctctgagttgaggagacagaaaatgatattcagaaagattgaggcttatggaatgttgaggaatggtatggaattttatggaattgaggcttatggaaagatgaaactggaaatgaagaagccacatggagaaagacatctgcatagggctggaagagggatcaccctgaatcagctgctgaaaatacctagctgagtatgcataggaagatgcttcatgagtgtgggcaatgccggagctcacagagtggtgggatttgctcaagttataatcagcacagtagtggaacatttagaagagatcccagaagtgtcctgccttttgtagtgctaaactagccatagagcaaaggtcattcaaatacacactaaaaagatttcttgaaaagtcttgaaatggtcaacctgcctgcaacatatgccagaacaaagtccaacaattgttagaagatcacaacaaaacccaggctttcaaaatgtaaatgtcacaatggttggtatctaataaaaaattactagctttgtgaagaaagtagaaaatattactcataaataggagaaagattagtgaatagaaacaaactcagaaatgacagagatgatggaaatcactggcaaatacagtaaattagctgttacaaatacataaagccatcaaggaaagaatgaatgtagagagaaaacaaagataatatatttttatgaaagaactttgtgaatttaaaataaaatatttgaaatataaacttcactggaaaatactaagaacagattagatgctgcagaagaaaagatcagtggacttgaaacaatatcagtggaaaatttcttgacacaaatagaaaaggaatgaagaaagtagaacctaaattaaccataggccagtatctacatctatcatatttgtaattagagtcagaatggggcaaggaaacttgcaaaaaatatttgatgcaataacggccaaaaattttctaaatctgatgaaaaagttaaaaaaagttcaacataacggaagcaggataaatgtcaataaaaccacactagcgcacatcattagcaaattatgcaaaaccaatgataaagaaaaacattttaaataatcagaaattaaaagacacattacatccacatattatgcacatagtaaaaacgaatgactacagacatctcatcagaaaaaagcaaactggaagacaatagaacaaaatgctgcaaatgctgacggaaaaccaaactgaactaaacaaaaattcttaatagaaaaacaaacctagaagatatttctcacttaaaaatgaagacaaaaagaaagtttcaataataaaagaagtgagaacgttctgtcatcaaacttgctcttctaaataacaaattgatcaataaaaactaaataattagaaaatattttgagctgaaggaagatgaaaacacatcagattccaatttacgtgtaactacagctgtgattagaaagaaatttatgactctaacttattatataaaaataaaaacacaacagatcccaatttaggggttactacagttgtgattagaaagaaatttatgattctaacttattgtataaaaagaaaaggtttaaaatcgataatctcctctttcaccttaaggaattagaaaaagaagagcaaattaaaacaaagttgaaagaaggagattgaaaaatgactaagaaggaaatgatattgaacatagactagcagtagagaaaatgtatgaaaccaaaagttgcttccctgacaagatcaataaagttggcaaaattctagtgagagacatgaagaaaaagagaaaaatgtaatgccattaataaaagagatgatgtttatacaaatgctatagatattagaatgacaatagtggaacattatacgtaattttttgccagtatattaggcatcttagatgaaatggaaaaattccttaaaatacacaaatcactaaacattcacacgagaagaaatacagtatataaatatgcaattaacattctcctcacaaaggaaactccagatgcagctagtttcactggtgcattttatgcaacttttaataagttaataccaagtttacacaaactctttttaaaaatataaggcaggccaggcgcggtggctcacgcctgtaatcccagcactttgggaggccgaggcgggtggagatcgtgaggtcaggagatcgagaccatcctggctaacacggtgaaaccctgtctctactaaaaatacaaaaaattagccgggtgtggtggcgggcgcctgtagtcccagctattcaggaggctgaggcaggagaatggcatgaacctgggaggcggagcttgcagtgagccgagatcacaccactgcactcgagcctgggcaaaagaatgagactccgtctcaaaaaaaaataaaaaataaaaaataaggcgagtattgaccagattccaaatccagacatatatattaagaggacaaaaaaaagatcaaattttctcatgaatttaggtgcaaaacaccttaactaaataatagcaagtcaaacctagcaattatagaaagtatgatagtttgttatggccatattgggtttacccaaagattctgtgtttgctataaccttcaacaaacaatgtaattcaccgtattacactgacacctcaaaggagtttttaaaaacttgaaaattttggcaaacaataataataataaattaataggaatacctaatcaagataagatagaaaagaaattcctgaacttcatgaatgatatctgtaaaaatactacagctgacatcatgcttaatggtgaaagaatgatgctcctgcctgaggactgggaaagtcaagaatatttgttctcactccttctgtgcaacattgtggtagaggacttagccagtaaagtgggtaagacaaagaaatatatgcagtaaaactgtgtttatctgcagaagacatactgtgtacaaaacaaaaaggaaggaaacaaaaaattgtggaatatacacacaataaactattgaaaataagtgaatttatcatggttacatctgtaggccaatacacaaaattcaaccatttcatcaatgaaaatgcaagatttaggagtatttttaaaatgctgtttaaagtaacatcaaaaatccatggagtatctaggaataaatccgataaaaatgaatacctcctctaaaatctgtataatactgctgggagaaattaaagactcagatttctacagacatagacttgtatatatctgtatacaatatgtacacatggatatatgtgtgtacaatatgtatatatgcaaacatatatgtgaatgtatatatatggattagaaggctatttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggctatttttgtgatgtaaagtctctccaaatagatctataaatttaatacagtgcacgtacctcaaaattccagcaagttactgatgtccacttcatgttttatcaaattttttgatgtttcatttttgctatttctctattactgtattttcaaggtcattactcttttgttcttcagtgcctaatattttattaatatcacccagtatatttttcatcttagatcatataattttcatgtatttcagattctgcagtttttatttttagaaatatataacatgctcatgctttttctaccttattaaatacctgaactacaatccaggtgtcctcatcctgtgtttctgtatcccttttaattggtataggtacctaggtattgtgaatcgcatctcatttggtgctagataatcttgtattttgctaaaatattcttaagcaggttaacaatatgatcagatttgcattttgaaaacgtaaatgataaatttaatatagaagcaaatgaaaaagttttactggcctaatgaagcttacttagaaaactgttgtagtaattcaaaagagaaatgatgagttaatcagcacagtgcctgccaaatggtaacaagtggataattttttgttgtgtcacactgattctgtttaatgcataggggttagctatttacactaccctttttggtttacagaatattttatattggaaagcaattctatgctgaaggaagctatcctgaagaagaagataggaaagccagaaattaaaatccttcatattgacgactatggtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaaatcatgtataaagatgtgtaaatttttttgaacttcttgcatcccacatggagtttggtgctactgccaggaatagtgacactaaatagtttgatttgtgggtgtctgcttagcaattactcaagccctgcgctctttatcagttgtttatgcaacattgtggaacatgtaattccactgctaaaacaatgggttatgtttgtatcactcctattgatttttcctcctgcatgcatggcctgcagtaagctgctcctatgctcagaaaacttgactcaagtttttttcatcttgaaattgactttgaagttaaatatctttatacattttgtaaggctatatcatgactatatagtattaggcaccgaggcccctaacatctaatgcgtaactaacttgatattgatttagcattgtattcctgagagttataagttatttcccttattaatatgatcaggtagcatattgatataatagtgcttaaaacagtctaaaattatatctttagatacaataatttcttcagatataatatttagaaatagtaaatatgaaaataacattgcttattatgatcactgagtatagtggataagtattcagtctgtggaatcggatttcctgggttcatattctagttttgctatttattagctgtgtgtccttgggcaagttccttaacctcctacaaggctaagtttctctaaatataaaacaatcattacaatacaacctgtgttttaagactgctttgtagactgagtgaaatacaacatataaagtcccttaaacagtgcctaacacatatgattcttataattattgcgattataattcttttttgtatagactgcatttattttatttagatattttaatatatacaagcaatttgtccctttattttaacaaaccacataatacagaaataatataatatttaattttctctctcactctagtgttcatttctaattctaattattgagctttatatagtttctcatatccaaacttttctcccttgtccctaaaagccagaaagctctgaaagttcttaatgtctccttgaggaagttcttatttgctgtttcttaattcattgtttttttttcttgtcttttttacctagtttcttctggtctattttaactgtatgtatgatttactgaggaaaaatgtttaaggcactaaaacgagacaaaaagaaagcaaaaatcaaacccatcttctatctcagtcacgtctccctttggtaaaaggaaatgttcttttgattcactgaaaaataaactttctcaaggaagggacatccctcaggcacatcctaggcatccctcagtatgtgatgaccttcaaaatggaagataaaagaactgactgcccttgaagcatgatatttatgcagacgaatgtgtagataattatgcccacttgcgtatccacctgctgtagggcagtgtcacacatagggggaaaaccgaataagagttaacagaatctctttgttttctgaaacagataagctaactggctcatcttggcatcagacttgtgttttgttctggttgatttttagtttataagaggaatataaggacctacacaagaaaccaatttgaagacttctcttattggcaaggggcacttggggttttttttgagaagtgggattttggagcaaaatgctggttttggagtcaggtaggactgggttcaagttggagtgctgagatttaacaatacactgctgaattttttgaatcttctgttgccttataaataaattggggaaaataacatgggataatatttctatttaaatatattaccatagtttttggtagagcataagcacttgcagatagtctttaataaatcataagcagaattataattattattagtatggtgcaaaagtaattgcagtcattataaatggcaaaattataagtaattgcattacttataaatgcaaaaactgcaattgcttttctgccaacctaatatggataatagtattttaaagtatttaatgtgattaatataaatatttaatgtgtaatttaatgcccataaagttattcaatagacagacactactaaaatagataaaatagtgccgtcagacccatggaatttactttgctacttttttggttgatacaggaagaatgaatgaaaatgagtataaaatcatttctagttatactttgttatatatagttatatattgtttatactaaatattaattgacattatccacacttttgggttttagagggaaattatcgaaagcgtcacagaatgtgacttacaaaatccaaaaggagaatttctttttttttaaatttatacttacaatatgatctattcttttaaattgcatgattatttctaaaacactatgcttgaaaacatataagggtcagaatagcaaaagtagaaagtgttttttaagaattttaaaaactgcccatgatttaaagccatattttttctcaagcttaaaaactgttttcagtgacaaattgacttcccattctaaaagtaataataattattatttttttcgcaaatgagcaattagacagtgataaacaatagagcgactattatttaaatgagtctaagaggtcattcagtgattttggtgtcagtactttattgcaattttgtgccatatatctggtagccaacagaatatgagccatttcttgatctgtagtgatgggtttacatccaaggaattatataatgaatgcatgagttagcgtcaggctgcagcaagcacctgagtggctgaaagaaagactgccctggaagaaagtggcctctggcaatttggaaacccagttctgctcaatcttcattatggatcttcaaaagaaatggtcctctgacctcccttgcttggtcatatgttttgaaactcaaacttaatctcgtaacatttaaaatgtaagtgaatcaaagatcaatgtcaatgtcacattaaaaagagtatgcgggatggagtacataccacattaatatttttactgtagaatatttttaccataatggaaaaatctaagaagcattggcaccatagatggatctcagtgacctgagtttgctgtggtctctacggagtcatgatcccctttttctgaacaactcctccaattctcccttcaagtgcctatttgttttactcctgcctttctgtttaacattatagggagcccttaaggacccggagtccttattcatttttaaacttattctatacacatctgtattcattccagctcttataacctcgtattgttcttttttaatattattcttacttcctactcatgtttatgtaatttaataccatacacgtctaccacattgcttttacatatgagaagccgtgttaatggctatggggagataacaagattgcaagcatcttgaagtctataatagttatttgggtttgttcagtctatctccgcaatgcctaatacacagaacttactgactatcctgtaattaccaaatagtgccaagactgaaggtgttgtggaaaatgccctgcacttgcagacgttcatttggtaaacaaacaaatatgaatctaatatacttagatgctgataaaagcaatccagaaggttgtactgttatttaaaaagaagggatttttgtttttgtttttattttctgtccctctgaagaggagcagcatcagctcaggagtttatttcagtaccaagggcccgtcatctcttcccattttctactttttcatgctcaagttatcttgccacactcgttaaaggtctaataagggaggcagtaaatgttcaacagattatattaacttccagaatgcaacatatgctatcttgcctccatgactttctttcctttctctgaattcaccttccttgaaatcccaagaaattcatggtcatccatcaagtcttatcttcctggagctttcttccattctcctcctctgtcagcctatggatcaggtcattctaaccggagagcattattcatttttatctagagtctcatcactgaatgttctgtgtatcagaatcctataattgggtcatcttggtagaagtgatctgttttctatataagtattctttcaaacagcatgatataagtaactgatcattcacaatgagggaatatattcagttattcatatccaacagtcaagataacatcattgctggtttgttatacacacatttcatttcctcaaacaacttgaaatattgtttaatattttaattagcatcaagcttcagacaagtcagacatcctatctggatgactgaactctaacctgctatactattctctacttacacttcctttctttagtttattgctttttgctctctctctcttttagttgcttttccactctgctgctaggttgaacttggcaaaatccatatctgagaatgtagccctcctatctaaaatcttctcattattcattcatcattgattaaagctctgcgttttccctcacactacgtaacagtcttcatgatatattttctatttttctcttcgtttttatctcacatcagccacccccaaagagaaatcccatcctttagacagactgctttgttctggggaacaccaccacttcaatcatcacttgtgttttcacatagcctcccagtgccctgagtttgcctgcccacctggagaagttctcttaagacttccagacacacttccagataactttatgcacaccgctattacaaacatgtaaccataccagattacaacatttactttgctttctctcctgttaaactgccaattccttttgaatagttttgccataccgcactaactggagcattatttgatagaataaatgaatgaatatatgaatacatcaatgaataagtaaacaaatcaattaaccctgagtttgtcctcaagaatgaattaagtcgagatggagaaatggagaaataaatgatttgtgagtttataattgatttctgtatgggtccatttctctgcaatttagttttgtactcagaatgagacgcgagtttctaatttctcttatagtctttctggatagggctgaatattgattgattttcatgctgtctcttcactgtttctttttacaatttttttacttagcttaagataataagaattgatattagctaccatttattgttattgtgcaaagagtgtcttgctgagaatatttagacatcatctttagtccttatagaaatcatccaaggtgaatactactgtcctcatgttaacacaaggaaactataactaaaataggtcatgtatgtgttcccccaagttcacagaaggaaaagttaaggtttggactcaagttttatatatctattttctgtattaaaacctctgctgtattacccaatgctgcctgcctacatagtccaccgtattatgataattattggcatattatcaaagaatgatgacttgaatcagaagaggcttctctactgccaaattcttatgaacttttcttctttccactgaacagtttataatagtttctggaatataacattttccacatgtactatgttaatgctttggtgtaaagtattgattatacaaatcatgactgagttcatgaatattccacaagagagatcaaattctcagctcagattatttaataaaattctgaattctcatcaaaatgttcactttgtgggaagtcttttctactctgtatttgtttcatagattcctagggttttcgcagatcagattgtgagaggtgagttcattttgtttcccaaggatgaagacatatatattccaataacttccaacatcatttgatcttctatttgttcatgccaaatacacatctacttttaccctcagtttcttgcaaaaatagtacatataccgtctgatgtgggtgaaagagatagcttgttgatattaatgtttgtctcaaagagggattattattgctttgccatataatgaggttcaaagcttaaattttaggtttatcatttttgtatctttgtcatttacatggatggagaatgtacccacactgtaatacatagaaaatgactaagaagaaaaaaggcagtggcatttaatcttgttaatagaaggggagaaggtgatcatttgtttctgtttttttcttgaacatatttaaacttgttctttcacaatttgtagataatgcatcttaaatgtcagcattaacttcttaccactatttaaagttgtacaaactcaaacttgctgtattaagaaggtgacatgggggaaaaacccaaatttagataaatttatagataatgcctaagctataatatttgtttggtgtttattttaactggaatatatatatatgtgtatatatgtgtgtgtgtgtatatatatatatacacacgtatatgcacacacagaaacacacatgccattttaggtcttctgttaacataggttttagatatgcatggattcacagaattatatgaatgatataatatggtttcatatgaatgatatgggcttattaatagttcctatttaaaacttacatgtatatgacatatttacagatacactactgaatactttttataagaaatattgaacttcgtaatttacaaagttcttagttttagatggtcatataaatgtagtcattaatgtaagggtaattcatattgaaatcagtctctttttctgttttaattagttatttgtttttaagaaaaaacatattaggatataagattaactatattattagtttaacatgactttgaaaggtgaagttaaaaataccaagatacagtgtattctttcttggtaatcccacacatctccacatcagaggaatacatcaatgacattatgttattccaggattttttaaataatatattctttccttttgacttatatataaaaacagtacattatgaatcatgtaaggctgtgtagcatgtaagtcaaagtgtgtctatgatgatgggaggctaggccagagctccaggcttttctagtccaacatacatatatttttgagcaacaagtaatgtgcaaagttccctactaaaaattacagggcttctaggagatataaaacttgggaagaaactaataattattgtatttttaaaagaaaaccacaacccaaataatacaattgttattaatatagtaaagttttaatcaacgttttgatttggaatcattcagtcattttcagcattggactttagcacttgttcttcctcttggagggcattctcttatagccgttttttctcatttttagcatgccattttaatcaaaattataaacctgatctagctgtagccttcttcattaatccactatctgagtccatgtctttgtagcctgtatgattagagctctcagttgtcacctgtccctcagtaacatggaggaagcataatcaattggaagttgctagatcagccacaactcaccctaaaaaagtgcttccgttgatttttagcttttttattaaggttccaatatattgctaagactttttccttacttataagaaaatgtggctctgatttcctctagacattaataccttgggaaaggctgtgtctgcgccactatgacagtgcattatactgacataatctccctgtttttcatcacatagaaaacatgtcatacaagataaatctatgttgcacaaaacatgctgcatctttgggaattaaaagtgttgaaaattatattgatacatatatgttaatgtataggttatatatattttaatttataagggcacacaaaaaaagtccatctatataacatgtagtttacacacttcctatgcttttattttttctttttttattaatattattatactttaagttttagggtgcatgtgcacaacatgcaggtttcttacatatgtatacatgtgccatgttggtgtgctgcacccattaacacgtcatttagcattaggtatatctcctaatgctatccctcccccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcaccattttttatggctgcatagtattccatggtgtatatgtgccacattttcttaatccagtctatcgttgttggacatttaggttggttccaagtcattgctattgtgaatagtgccgctatgaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattataactggtgtgagatggtatctcattgtggttttgatttgcattgctctgatggccagtgatgatgagcattttttcatgtgtcttttggctgcataaatgtctttttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgacagtagtttcttttgctgtgcagaaactctttagtttaattagatcacatttgtcaattttggcttttgttgccattgcttttggtattttagacatgaagtccttgcccatgcctttgtcctgaatggtgttgcctaggttttcttctagggtttttatggttttaggtctaacgtttaagtctttaatccatcttgaattaatttttgtataaggtgtaagggagggatccagtttcagctttctacatatggctagccagttttcccagcatcatttgttaaatagggaatcctttccccattgcttgtttttgtcaggtttgtcaaagatcagatagttgtagatatacggcattatttctgaggctctgttctgttccattggtctatatctctgttttggtacgagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataggaaggcttgtgatttttgtacattgattttgtatgctgagactttgctgaagttgcttatcagcttaaggagattttggcctgagacgatggggttttctaaatatataatcatgtcatctgcaaacagggacaatttgacttcctcttttcctaattgaataccctttattcctttgtcgtgcctgattgccctggccagaacttccaacactatgttgaatgggagtggtgagagaacatacctgtcttgtgccagttttcaaagggaatacttccagtttttgcccattcagaatgatattggctgtgggtttgtcataaatagctcttattatttgagatacgtctcatctatacctagtttattaagagtttttagcatgaagcgctagtgaattttgtcaaaggccttctctgcatctattgagataataatgtgatttttatctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcttcaaggatattggtctaaaattctctttttttgtagtgtctctgctcggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgctccaatttcggagcctgttattggtctattcagagattcaacttcttcctggtttagtcttgggatagtgtatgtgtcgaggaatttatccatttcttctagattttctattttatttgcatagaggtgtttatagtattctctgacggtagtttgtatttctgtgggatcagtggtgatatcccctttgtcattttttattgtgtctatttgattcttctctcttttcttcattagtcttcctagcggtctatcaattttgttgatcttttcaaaaaaccagcttctggattcattaattttttgaagggttttttgtgtctctatttctttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctacacactgctttgaatgtgtcccagagattctggtatattgtgtctttgttctcattggtttcaaggaacatctttatttctgccttcatttcgttatgtacccagtagtcattcaggagcaggttgtttagtttccatgtagttgagcggttttgagtgagtttcttaatcctgagttctagtttgattgcactgtggtctgagagatagtttgttataatttctgttctgttacatttgctgaagagtgctttacttccaactatgtggtcaattttggaataggtgtggtgtggtgctgaaaagaatgtatattctgttgatttggggtggagagttctgtagatgtctattaggtctgcttggtgcagagctgagttcaatttctggatatccttgttaactttctgtctcattgatctgtctaatgttgatagtgggctgttaaagtgtcccattattattgtgtgggattctaagtctctttgtaggtcactaaggacttgctttatgaatctgggtgctcctgtattgggtgtatatatatttaggatagttagttcttcttgttgaattgatccctttactattatgtaatttccttctttgtctctgttgatctttgttggtttaaagtctgtttcatctgagactaggattgcaacccctgtctttttttgttttccattttcttggtagatcttcctccatccctttattttgagcctatgtgtgtctctgcacgtgagatgggttttctgaatacagcacactgatggttcttgactctttatccaatttgacagtctgtgccttttaattggagcatttagcccattgacatttaaggttagtattgttatgtgtgaatttgatcctgtcattatgatgttagctggttattttgctcattagttgatgcagtttcttcctagtcttcatggtctttacaatttggcatgtttttgcagtggctggtaccggttgttcctttccatgtttagtgcttccttcaggagctcttttagggcaggcctggtggtgacaaaatctctcagcatttgcttgtctgtaaagtgtttttttctccttcacgtatgaagctcagtttggctggatatgaaattctgggttgaaaatgcttttctttaagaatgttaaatattggcccccactatcttctggcttctagagtttctgccgagagatccgctgttagtctgacaggcttccctttgtgggtaacccgacctttctctctggctgcccttaacattttttccttcatttcaactttggtgaatctgacaattatgtgtcttggagttgctcttctcgagcagtatctttgtggcattctctgtatttcctgaatctgaatattggccttccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttcatgcttcatttcattcatttcgtcttctatcgctgataccctttcttccagttgatcgcatcggttactgaggcttgtgcattcgtcacgtagttctcgtgccttggttttcagctccaacaggtcctttaaggacttctctgcactggttattctagttatcctttcatctaatattttttcaaagtttttaacttctttgccacgggttcgaacttcctcctttagctcggagtagtttgatcttctgaacccttcctctctcaacttgtcaaagtcattctccatgcagcttcgttccgttgctggtgaggaactgcgttcctttggaggaggagaggcgctctggtttttagagtttctggtttttctgctctgttttttccccatctttgtggttttatctacctttgttccttgatgatggtgatgtacagatgggtttttggtgtggatgtcctttctgtttgttagttttccttctaacagtcaggaccctcagctgcaggtctgtcggagtttactggaggtccactccagaccctgtttgcctgggtatcagcagtggtggctgcagaacagtggatactggtgaaccgcaaatgctgctgcctgattgttcctctggaagttttgtctcacaggagtacccggctatgtgaggtgtcagtctgccccttctggggagtgcctcccagttaggctactcgggggtcagggacccacttgaggaggcagtctgcctgttctcagatctcaagctgcatgctgggaaaactactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttggagcttctgggctgctttgtttatctactcaagcctcagcaatggcaggcgcccctcccccagcctcactgccaccttgcagtttgatctcagactgctgtgctagcaatcagcgaggctcggtgggcttaggaccctcccagccaggtgtggggtataatctcctggtgcaccgtttgtgaagcctgttggaaaagcaaagtattagggtgggagtgacccgattttccaggtgccatctgtcacccctttctttgactaggaaagggaattccctgaccccttgcgcttcccgggtgaggcgatgcctcgccctgctttggctcacacagggtgcgctgtacccactgtcctgcacccactgtctggcactccccagtgagatgaacccagtacctcagctggaaatgcagaaatcacccgtcttctgcgtggctcaggcagggagctgtagactggagctgttcctattcggccatcttggctcccattttttttttttttttgagacgcagtctcactcctgtcgcccaggctggagtgcagtggtgcaatcttggctcactgcaacctctgcctcctgggttcaagctattctcctgcttcagcctcccgagtagctaggattacaggtgcccgtcaccacacctggctaatttttgtacttttagtggagatgggcttttgccacgttggcctgactggtctcaaactcctgacctcaggtggtccgcctgcattggcctcccaaagtgctgggattacaggtgtgagccgccgcgcccggcacttcctgtgctttcataagaacttgtactctcaccgcattatgattacaacagggcagatattctaatccccgtttttgcaggtgagaacccttgagggacagaactgatgagcaatatgcctcatgttggacaactactaagaagtgaaaactcagcaacaatgtgccatacaagcttttattacttttccctaagaaaaaattctagggataaaggaatttaaaatacgtggtgtaaattcagaaaaagacccataattagagcttaataaataaaagagattttttaacaccttaaatttataatcttattctggctaagaattccaatttccttttgccttgaggatataattgcttatatgccaaaggtataagtgaatattttgttgaggtcaacttttataattgtgttctctcaaaaaactggtgttatttgtctatctatggtttataatttctttaccgctatatgtcggtttactaagttgcaagatggttctgccactgcctgcttatacttagtactataatcattattattcctatttaactgatgcaaaaactcagctaaggtgtaaaattccctatgtttatataaccacactttccagttgataaatggatttttagaatgcaggtaaaggattatatagttagaaaaccagtattgtatcaccaccatacattactgaaggtgtcatgatgccctaccaaggatgaaatacaggttgaaagttagtaataattagcatccattcctgtattatcaacccattgcacacatatgtatccttcgatatgtagcctatatgtattgtcagcctcagtacgtactcactacattcccatgctgaattgccctctccttgaaaaaatacagaaatttaagtttgttgtggagattgtcacctgcttcttttttaaagatacacacactttgttctattttttatctaaattgcccccccacccccagttcctgaagcaagcatgtagaatattttccatgatcatatccaaagtggacctgctgcataggagagtcacattgcagttatgtgcacgtgaaaactgagataaattctcctgtctttggtgtgtttataaaatgtgctaagctttcttttaaccatgaataatttaggtatgaccctttctaagtgcaagagaatagatcaaatgctatcctagctctgtgatgatatagctattcccagcaactgaaagaaaagatcatcaaagcctcttacctttctacttactcactcacactgttagaaattatctcaaatgaaaattggccaaaggataagaattaatgtactaagactttgacagcaaatatcattaggagattgtacattccttctattttattgaacaatttctggctaggagatgtccctgaggtccttttctattggttgtattcttatattttcatgtgctgtccaagatgtttatcctgaggttaattttgtgtggataatgctaacagtccatttctgagttttagagctggctcattaatatctatgctgttcagtgtttcaacttgtgtaacaataaggctttcagtttttggatttgtactacagtacgcgtaactgcagttaaacaactggactctgttttttcttcattactctcatgatggtcattatgcagtttttgcatcaggctaaggagacaatctctggctttcattcaagataaagagcaaaatagtatcaaattcccttcaagacaaggaagagtgcctttggccgataatagttcatcatgacataaggaaaactatttcattaaaaatagaagagagaaaaaagggacaagtaggaggaaggctaggggagagatccaaaaaaagattcaattttattaatgcaaaatacccaaacttggagatcaagaaaaaaaaaaacattaaaacatcaaatatatgtttgggttttttttaattctttaaaaacacgaaaaattctgattgaggaaaaacattaaatgcatttttcaggtttatctgaagtcacagataacaatgttaatgaacagacccacatatgaataagtgaaaagacttaagaatgttttctttaaaatcaaactataactgagttcagaggcactctggattttagcaatttaaaagcaatcactgctactaatctaactatgaagaagctcgtaagatacctttaacatatggataataaaattgcaaaagtgccagacacgtgttcgagagatacacgctgagcagcatatacgtgtgcgaaaggcacaatatttcttttccatttgtatggccgtgtaactataattcaagccagcgaagatttatttatgtgacataaagactactagaataataaagagatttttaaattatgtgtatttgtgcaaatagactagaggtcaagaatacttcgatgacataaaaccaccttccctgagaaacgatgttcttgaatgagagtgcaggaattattgatgcagagttgcatagagatagtcagatttgggtggctcagcttctacaagaggaatggaaggtgtaaggtcaagtcccaaagtgttgtccagaactaggttaataatattgaacacctataccaaggaccaggcactttacgcagctacatatagaatctcatttaatccctgccataactctactgggtagatgctattatcaccctctataccaaattaaaagcaaacgtaggcataagtgtctaaagccactggacctgggctcaactcagtttgatttgatccccatatcacctgtaccttttcacagtgacatgcttacttctttataaagtctaggtcatgaatgcaggcaacctttctgaaggtttgacaatggacaaagtctgagaataaaaatagatgagtacaagtgatttggaggttagtacaatttgagaatttaatttatgaacagaattttttatacattatcaggtagccttcatcataatcaccgccagaaagaaaaatcttagaactaggagatagggtcttggtagcggcatgaacaaccttgatcgaatcaactgctttcctggttatgacttataaaaaaaggaattcaaccaaaagctacactgtaaataaactagggtgaggaatttgaagattatcttaacaatatccctaatggaagaagatgggaatgtggacaagaaacagttctctggtaggaaaaaaataatgtaattccttacatgatgaagtaaatacagtgtatgagaaaattcattcagccattcttcatgtaggaaaatccatctatgagaagaaatttaaaaataataaagagataaatagaaggaattggcccaagaggcccttagccaatatgtggatctatgtgtacatactgcttgaaagagggcaaacttcattatactttagatacacatatgctgcaactaaatcatcatggattataaatctctataaagtaaatttttaattaaaccaaggcaaatattgtttaaagctgctatcctatgttaatctcatattctacctgaaatgaattgtcatgaagaataaaatggaagcatagatagttgattatgcttcagaatataaggtaatattgttctttgcatattgtttccttttccttaccttgatttttattctgttctttactcctcctttcacattctttttaaattcataatacctacaattaaattgcaacccttggttctcaaggattctagctttcaaacaggtactcgtgcaactgagcgaacctgttgtaggcctagaaagagcaatgaactgagatgactataaagcagttctctctatgtcccctctttccactgccccagtggacacaggtaagcagctgacaaattctgccatgctttcaactggtcgtcagaagtcctctcgttagaataatattcttccttccatttattataactaaagctttactgataaggataagagctttcaaaaatgtacttttaatggggtgcggtggctcacgcctgtaatcccagcactttgggaggccgaggcaggcggatcacgaggtcaggagatcgagaccatcctggctaacatggtgaaacctcatctctactaaaaatacaaaaaattagccaggcatggtggcgggagcctgtagtcccagctacttgggaggctgaggcaggagaattgctgaacccgggaggcggatctggcagtgagccgagatcgcaccactgcactccagcctgggcgacagagcgagactccatctcgaaaaaaaaaaaaaagtactgccctgataatttgtgatcttaactatttaccaccaaatattacttaacaatgaaaacaataaataaaaataaaaaaaccaattaattcctcaaggtacctcagcagattggtaatgaaatcaaggactaaaaccttagtcttctgtatataaattcaaccctctttttagaatttaattgaaacactttgtgaacccgatcaaacatgtagtttgaacaaatctctatactttaatccagttttggtataaatgatgttttttatgtcataaagaggtgacttgttctgtcatttaaaaaatctattgagtattgtttgttttattccattttttctatattttattatattgtgaactcatccatacagacacattcagtgttgaaggtattgaaagagatgaggattctgccctcaaagaccttaacttctaagaaaagtttgcagtcttaatttgattctgctacttgtgttaggaaatagacaagtgtcatattgctatgaccttttcactgcttaaaacagatggaattgttcttttcaccgcaactttcaacaaagttgtatgtccccactctcaaccttgaaacacccttcttactgtgaatccccaaagatttctgagacagagataaaaaagcaaaattgtgtagaaggcaaatgagggagacactcagaaagaaacaaaaataactaaatcaattggagctcagcaatcttgcacagccaatacacacatgagtcgtggtacccatttattataagatagatgatttgtctttagtacattctgtgtggttatccctagcaccaaatgttttgctattcctattttactgaataagcactctttgcttagctttatttataagtctagtattttctgctcaacactttgtgaacaagtaatgtccctcattttcctgcacatgcctgatttgttccttataatgccaatgattagcatcataatccatgttcttttaagtgtatgttgaaatagatatgcctatattgtgcaccaaagaaaaagaaacaacacccaattagatcacagaaatgggttcaaaaatctttggttcataatgaattgataccacttcgtgatctaacatttaaaccttggaaagactaggttaaagtttaaaatggcaattaagagaagagagcaaaagagtgaaattgtagttttcttctatgagtgtagcaataatgagtaaaggattgaaggatttgttttaaaaaacctgttgccatttactaattgtgagtttgaaaactgtgccttattttaaactctatcttaaaataatttacttgcctgccataaaatgtctgacttatttacattttaactaaacatatcttagctgggaacttctgaaatcgctgtgaacaaggcaatgtgtcatacgtagattggaaagttatatcttttaaataaacaaaacatcttatgttgccttagcactgctgccagagtttataaaggtgaacaatcctgccttaaaagttaaggacactctggtgatcactccaagggtctgttgattgcactttttttatatccttgtaaggctttagatttcattggtccatctagaaaatgggattacctctgacataagagctcatattacatagcaattatgctttatccatagatattgtgcatttaattactgtacaactagccgaaattctttatatagttctccatttttaagtgtaactcaaagaaatatgctcaacataagcaaaattttcttcaagtaaaagaataaaaaacagttgttattgtcctataaatctaatcatggttttgttcattatacttcataaagtattttcaaatgccttatgccattaatgcttacaaaatgtctttgaggaaaatatggtagtattggccatcattatagacacagactgagtcctagtgtttcagttatttttgcctatgttggtagtaaagttgagattcaaccttggtatttttactcagcttagtattcaaaggtgaagttaatctttggtacctgttctctgtgaatcaaaatatttgcaataaatccacaagcttcaaaatgcagtatctttatgtaaactcaagtctttttaaggcctttccattttaaacttcatctattttccctgaagaaggtctacttcaacaagcattggctgtgtcctatgcatactagaaattatgctaggcatgattcgtgctagttctcaaatgttaaacaagctgtatcaggatcaactgggcaactgaaacaaacaaacaaacaaacaaacaaaaaacagcaattccaggcttacttctgaatgaagacatcagacttctaggttacagcatggggatatgggtagtaataaatttcaaatgatctgatcaagagccaaggttgcataaattaaaatacatttaaaaagaaaatataaaagaaaagagaaaatatctaggtggcaaacactgtggaaagacaaggcatattttgatttgaatcactgaaaatcacattaaatgagtgatttagaaaagaatggaggagagttgtgattcattaatttctatggcacagtttatttacggtgtttctttatttataatacatctcataatccacataatagaaaacttactcccaaaaagatttactaaactttggaaatatggagtacatgacataatggatcttaagtgcttagaccacagaaggcatttatattagtttgctaggaccaccataactaaatatctctgactggatatctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctgactggatatcttaaacaatggaaattaattttctcacagcgctgaaggctagaagtcaaagatcaatgtgccagcaggattggttatttctgagggctctccttgggttgcagacgaccgccctctttgcgcctcttcatatggtagtcccactgtaactgtgcacctctagagtcttttgtgtgtgcaaatttcctcttctttaatgggcaccagtcagattgaattagggcccacctttgtggtttcattttaacttagttacctttttaaaggacctatctccaaatatagtcacaatctaagcaactgggtgttagggattcaacatataaattttggagaacataattcagcccctaacagcttttaataaattttagttgctctgtgttttgtctgattctctacttacttctttatgtcacttacaggattccacacaacccctgtatctgctcagtttcatttgttgctgaaaggttatttgctgtaggaaatctgataacttgaaagcttgttattggagatgatttgtgtatttggggcttctagataaacattcacataaagaggaaggcgggagagtttggtgtttttaccttgaagagtgagtaggctgggaatttctcacaggttgcccaactaacaatggagatcctttcagggttggatgtttaaatggtctgtaaatctatcacatgcacaacttcctattggaactatatctaggtatggacctagatattctatgtgattgtttcagagtctgattttttactttttctgtattctagaaaattaactaataaatattttaagctgacattttaaaattgtaccttcttttccctgtggaaagaacattcatgctttattatttatgtgtctttctttccttctagctttcaagtttttcaaacatatatatctatgcttctttctgctgtcaactttagtgataaaaaagaatttttctcactgcttgtttaaattttcttcagtgagaattccaccacagaaacaaacaaacaaaacaattcaggaaatactaatgcagttttttttttaagtttaacattatgtatggttgtacatttcctgttaaattattatcaacttttcataactggttctgcccttcagcccttggaagccatttgcaagacatttctaaaacactatggaagaaatccagtaaagatagacttgtctaccaacttgacagtcattctttagaaatgcctttgggagagtatcatccattttcttcatttttccccattgagaaatgagctaaactaatttctactgcaatgttaactcatactttcatttcattcagggaacttttcaattacagttttacaaaggaaaatacaattttacgaaggaaaattgtaattttaccttcaggtttattatcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaagtaagtggatgcacatttttcttctctgttttctataatgacagagtcttggtatatgacatataatattactaaccctgactcaaggcttctattttagtgattgagcaattttgtaagttaatcataaagcctatttcattttttttttgaagtacctgtcacccttagtgctataataaaagaattctcatatttcccctctggaattaaaatttactttggatttatggaagttggatacattttaattataccactatattatttgtttacaggaatccacaatgtctgttgtatcctcagttaatcacaattcttgaagtttcacagataccattatcacactggcatgaatgtgtgacctaagaaagttagtgggttctttataatagcacacagaaaccagatatgatattgttcaaatgtagatgttgattcagtaggcctggaatggggcccaggcttctgcatttataacaagctttcaggtgataccaaactactaggccatcactttgagtagcaagattttggagtatatgaccctaatacatgaacagagctacagttagtaaagcatttctagtcattagctattgttttgtatgtatgcatgccaactatatatttatatttgcatttaactcacaaagatataactattgtttttcgttttcattgcagatttttgctgaaactgccttacattgactccaaaagattaagcatttttggaaaggtaaatagtagaaatgctgaatctatctttttatgcgtatctatgttatgtaatatcctattacacattcacaggaggccagttggttacagataagttccatattgactgggattccatacttattaacatggaaaacctcactgtagcaagatttgatggcagaggaagtggattccagagtctgaaatgtatatatataatatatgtatatatacatacatatatgtattatttgtatgtatacatatgtaattacatgcttcattatattataattcctctgtattatcctttaaaaaataacataattagtattatatacagtcagtcatttattaattcagtaactatttattgggcagttagttggcacctggtgtcagaagtagaacaacaacaggacaaaatggggctttgttttcatgaagcttgtgttccagagaggggaaacagtaaagaggtaaatgaaaaacacaatttcatatagtaataagcctcataaagaaaacaaagaaaaactgatacataaaagctaactgcagaagcgcggccagtgtcattagattgagtggtcaatttaggactctctgatgaggttatatttaaacctatacctaaataacaaatggacgctggtcaaataaatctcttgaagcagaatattctccacagaaaaaaactagcaagtatcgcaatcttaggaaaacagacacaggcttagaaactaggaaatgaccagtgtgcataattacgtcatctgtgctctctgcacgatatttacttattgcagtaactgttatgtcaggttcaacattattttgacagtgggaaaatagacctcatatagatatttattagtttgttttttatttttgttttttgttttgttttttttttttttttgagacggagtctcactctgttgccaggctggagtgcagtggcgcgatctgggctcactgcaacctccacctcccaggttcaagcgattctcctgcatcagcctcctgagtagctggggactacaagcacgtgtcaccacgcccagctaatttttgtatttttagtagagacggggtttcaccatgttggccagatggtctcgatctcttgacctcgtgatccgcctgccttggcctcccaaagtgctgggattacaggtgtgagccaccgtgcccagcctattgagcttgtttttaacacatcagtggacaatgtattataaaggtaaaaaggccaggcgcggtggctcacgcctgtaatcccagcactttgggaggccaaggcgggaggatcatgaggtcaggagatagaggccatcttggctaacacggtgaaaccccgtctctactaaaactactaaaaattacccgggcgtggtggcgggcgcctgtagtcccagctactcgggaagctgaggcaggagaatggctgatcccgggaggcagagtttgaagtgagccgagatcgagccaccgcactccagcctgggcgacagagcgagactccgtctcaaaataaaataaaataaaaagatgaaaggaaaagggggaccttgaactattttagtttacaaataaagcaaattcttggtgttcatggatttaaacatatgatattttctactattcataagtaacctagagatccatgacataaaataactggtaagtttaattggggcgtaaattttagtggtacatactgacaggtgggtgtataaaaaaccacttaagaaatgagtaaaatacaaatcagtgcaaatcacgaccatcctctctccacttcaaacatctgcagtgtatcatgcctttgcagcattctacacttgttgtcagcaatattcaacagataagtaaaaatattttgtgagcattgctcctccaacataacacaaagaagtaaataactgaaagtgcatccctagtagtaaaggttagttttttgtttttttttttaaaggaaaacatctaagaaagtgatcatcccaaagaaatggaaaccctagatatattaaaaagtgaaatgaaatcctgtctcagactgcagcactgttaagccttagggacattgtgctaggtgaagatagccagtcacagaaggacaaatactgtataattctacttattacatgaggtgtctagagtggttgagttcatgaaaaaaaagagtgaaatggttgttgccaggatttgaggggagaggaaaaagggaagctggtttttaatggatatataataatggcaagaatgtaaactagtaaagtaaaaaacaaagataaatagagaacaaccaagccagaaaatacagttcattgaaaaaaaagagagggatggaggggtgacaaaaagggagagcaagagcagtaaaggaagaatgtgagtgcaaatgagagcaaggtgctctttagtgattagccattttatgagcccatcagtttcttattagggttcttggaatttttgtctagtttcatatttgcaagatgaaaaagttctggaaatctgtttcacagaaacaaatatatacctgacactacgaaactgtgtgtttaaaagtagttaatagagtaaattttatatgttttaccacatacaaaaaagtacatgcagtagggaatattttactccttaaaagtcctgatacatgtaataatttacaaatggcttagggcctatgtatttcaatgctctgcttactgtacacataaataagcataaaggaccaaataagcttttacaaacattcatggaaatttagagaagattcaaagggttgtaaaatgcctcatggaaaagggcaacatgagctgagtggtgatcagcaggtagaggggaaggaaaagagtctcatgcaaatgcacagtgtcagtgaagggagcatgtgtggagaacatgaaatgaagtagttgactgttattagaagaatgataggcaataagaatgagaggaagactgggccgagacgatagaggatcttcattgccactgagaaattagaagctcagcatataaaccatggaaaaataacactctaggcttcacatttagaagttcaaattctttttccccaaatcgtcattgtatacttgatgtgcctcagagcaaatgactctggaaaactaaaagagtgacataggatacaaacaagtaaaaatatgaatgacttcatcttaaatggaaaaaatattccaggtcaaacaaatatgcatatctgtgactgagttataaattaaaagttgactttctcaccatgtaaaatacactgtttatcctaagattccgtagaccttgcgattcttttttcttgaaatgcactgatttcagattcaaattaggttatgctaacctcataaaacgggttggaaaacaatgttcttgctatactgattccctggaaaaatttgtttaaaattggaactagactataaagaaatttggagctattgctttctgtgtgggattaaacatttaattagtttttaaatttatgtaaccaatagaagactattaagattttgtttaatttcttctgaggtcacctttagtactttgaaaagaatattttttcacttcatataacttttcaagaatatatacaaacagcaatatataatatcctcttattatatgcttaatcatttcacttgtggcagtaatatcccattttgatttctattatgacttactagtgccttcttgcttttgctagggcactctcttgctctcatttgcactcatgttcttcctttattgctcttgctctccctttttgtctctcctccatccctcttttttttgttcagtgaactgtattttctggctggttgttctctatttatctttgattttactttgctagtttaccttcttgccattattatttttcttctactttttatatacattttttcatcaattattaagttgaatgtctagcttattaatttttcattctttctttcaaatacaagcacttaggctgggtttggtggctcacacctgtaatcccagcaccttgggaggccgaggtgggcggatcgcctgaggttgggagttcgagaccatcctgaccaacatggagaaacccctgtctctactaaaaatacaaaactagccgggcatggtggcacatgcctgtaatcccagctacctgggaggctgaggcaggagaatcgcttgaacccaggaggcggagattgtggtgagccgagatcggaccattgcactccagcctgggcaacaagagcgaaactctgtctcaaaacaaaacaaaaaacaaatataagcatttaaattaaaaatccttttgagatgctctctgaggtatttttcactactacagagtacttttattaccatatagtgaaaatatctatttgtcaggataagtctatgtcttctgaacttttcttattatttttatgtcaaattgaatgaaataattttttggtacttttctgtaacttactgactataattgaactgtggccaaagaattgatcaggataacaaaaatactttgaaatatcaattgatttatgagttagggagggaatcattgttttatctttatcaattatttaattttgtgtaattaattttcttattttacttgatcctgattagccattttatgagcctatcagtttcttattagagttcttggaatttttgtttagtgaattgatttttttttcttttttttttttatttcaacagaggtttgaggactaggtggtgtttacttacatgaataagttctttagtggtgatttctgagatttaggtgcacccatcagcagagaagtgtattgtacccagtgtgtagtctttcatcccttacccacctctcactttttccctccaagtccccaaagtccattgcatcattcttgtgcctttgcatcctcatagcttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatctttttcatataatgacttcttttcctctgggtagatacccaatagtgggattgctagatcaaatggtagttctacttttagttctttaaggaatctccacactgttttccgtagtggttgtactagtttacatttttaaaacttccatgtgtgcctaaaagtgttagtgttacatatatgtccatttaatcaaacatatccattttgatgttcaaataataaacattgattttcactatgtcctcaggaaggtgcattaaagtatccctttataatgtgaactcatcaatttctccttattaatttttctaagtacattttaaggctattattattcagttcctgcaactacagaattattatatcttctggataaatttaatcttttgttgtttttattggccaagtttatctctattaattttttgcattaaagatttttatattcaaattacaataacatccttttttcattgatacatgtttattatcagcctttccaccttattattttcagcactttccgattgatttaggtatgccctttaaacaaaaagagagagagagaaatatgtttttatctttttgccaatttctgtatttttgttgaagattgtattcatttaaatttcttctaattactgataaatttaaatgttactgttttcattatatgtgccattatctgtcctattatatttcttgtgtcttccatttatttgaattgattatttttttctctttcattcttttttctaaatataattttggtttgttcaattatattgctgagaagtattgtattgtatgactataaaataatttgtttatccattcacctacggatgaacatttgcattgtttttagttttgtgtatagttattataaacgtgtacgcttgtttttgtgtaaacatatattttcatatttatttgtaaatacataagagtagaattgttaagtcacatagtaattccatgtttacctgtataaggaatttccatactcttttgaaagtattcatactttgtattttatgttttaggaaccatataggagagtttcatttgttctacatttacgccaacacttaatatcatcagtcttttaaaatcatccacaactgatgaatagtgggatttattttattttcgtttgtagtttactgataactgataatactggacaccttttcatgtgtttattgcttcatataggtatattttaacataactgatttgttgaccattcagactgtgcaacttacactttcatattaaaatttactaagtcacagaaagcatgttacaactgcaaacctattccttccttccccttttcatcatttttaattgagatataattgacataccatgaaattcatccttatatcatatcttaacatcagatagtagtgtcttaaaatcaaatagtagtagttcttccatcttgttcttctttttcaaagttcttttaactcatctagatgtattacatttctttataaattttagaatcactttgtatcttttctaaaaagaaaatacaccatagggatttcttatgtgaattgtatcaaatctataaatcacctggcaaagaaataactgacatctaagcaatattgaagctttcatatttttaaaagataattttgtttggtgttctgttttttctagtatgtgcatagttatagatattttttcattaaccatgtttaggttgtattgggttttctgaatctatgctttggtgctttctgtcaattctagaaaattatcaattttctattagaatattgtcataacttctcatcctccttaaacacttattaaaaatgtgttaaaatctcactttaacatggttattttataaacttttcttggtgccttttggtatttaattctgtgtcatacttgcttctatagtccaataattctctcttcatgtgtgactaatggttttctatattcattgcttaaatttaaaaaaattgttactagaagtttcactgagctttctataaaaatgtttagctatattttaactcttgctttgctgatgtgtatttttaaaaatatatttagcatcattatctgatattttacatcttattaaacaaatatcttttatttttgagtattggtttcttttgcctgttatttctgctgtctctcagtcatggtgatacttttccttgtgtactgtttatttacttgtagatgagtttatctttcttggaattttatctatggggattctttgatgcttttgttgcatttgtatttatgtattatgttttatttttaattgtgtatgctgaattgggaccacacaaaccaagtgtggacttatggctcaaatttttagtcaatattaattattttttattagctcagtacaagctcataacaggaataaaaattaaaacatctcaccaatctcttttatgcagcatgggcttttattttttgtcacatttagacaatgcttttgggatctagatttatttagggtctcctttagacccattgtggattttgtttacgccatccaccaaagaaggcattagaacgaaaggtcaaacaaagtctttagcatgtgaataaaacattggtttcatgctttatttttcacgtttccagctttcagtttgtatttggcttttgtggatttatgagatttatttttagtgtttggggttgtgcctttttctaaagccaccaacttatatttgtgttttatttatttgtttggttggttggttttactttggttttctttagttgagggatcaagtggagtatctgtttcacttaatgctggaaaagaaactgccataaatatgttgttctcatcaatgaggctgaaacaagtcttccttgtaagattctaggctaagttaaatctcaatgtaaaaagcgatgtgattcatttgagatatttcctcaaggaaagaaaagatgattggcagctctagttctaggaatttgcaatttctagtcaacttcttttctttacactcactaatatttgaatgaatttccaggttctgctttttctccttttggtctaagatttaccatgtttttatgatgatatatatctatatctagctagctaaataatttcattcattattatggactttgccagcaaaaactaaacttacactctgagatacatcatactgatatatatacacctccataaagccaaaattatgaaatttaaaaaaatgctcaatgtttttgtcgtgtgtataattgtttagtttaattttttgcttttgagtatggaaatgtttaataaggagctgggatttggcgatggctgtgaggcacgttctttttttatttttaatttttttaaaattttacgttaagtaccacggtacacgtgcagaatgtgcaggtttgttacgtgggtatacatgtgccatggtggtttgctgcacttatcaacccgtcatctaggttttaagccctgcatgcattaggtatttgtcctaatgatctcctttcccttgcgccccaccccccaacaggcaccagtgtgtgattttcccctccctgtgtccatgtgttctcattgttcagctcccacttatgagtgagaacatgcagtgtttggttttctgttcttgtgttagtttgctgagaatgatggcttccagcttcatcaatgtccctgccaagaacatgatctcattcttttttatggccacttcgtattccatggtgtgtatatgctacattttcgttatccagtctatcattgatgggcatttgggttggttccaaatctttctaatccattctaatcagtgttctttaactatgtaaagtgattaaggaatagaatgatggtatttctaagaatagtctttggtcacataatatatattttttagacaatactactacctcttttctatgtattaaaatgttagtcctataaacaccaggaaagcattgattaaattaattaccttctaaacctattacatggatactagaggaaaagagaagagaaacttcagtcagtacaaaagcatagatgtcaacttttgtctttttacatccaattttatttcaatatttcacaagtattcactaaattctaaaagttgcaactattacgtaaaatgggacctaatgatatttcaactgcatttactgttatttactttccaactgcattttctgcaatatagtttaactgaaatctctttgattataagcatgcattccacctttctacctcagtgtctttgttcatgccttttaacttttttctaacagcctctaagcctacatattgctttagaattctatctcttattaagccctattcaggtgtcgtttcctccattaaccattcactcaatctctcccactggaaaacactattccctcctgtgtactcatagaacactttttagtagcttcttgtaatcattataccagtatgtaatgtattacattcatttgtgttctgttttcatttctaagtcagactgtatgctttgtcaagttagttcagttttatttgatttttttgttgcagagacatttgaattgaacttatttcataatctttctttaatttggaattccctctccctctggatatccaaactttatccttttttcaaactccaattcaaacctttcctattctgaaagtctttacctcaatttcacacatagaatgttctataaatatcaatgaagccaaggtgattgaatgtattattcaagctttttatttctttactgattatctgtctactttttctatcaactaatgagagagggtgttgaaatgtttggctatgccataagacaaaattacaacatcttagtctaaaaatcttaattgctttatttgcaattctagaattgggcaagacttcattccatcaaatagaaaaagtgtcccaatgagctgggcagaagaggctggttttatagatagaaaagaactaaagaaagaagtaacaaaaaataaaaagcagattggtcatttcaaagttactttgtgaagcaggaacagttgaaaaataactggtagcatcaggtcacttgaggttacattttgttgtcagaattaaagcagaggaaacatcattatcatgctgattgaaactggcctgtttgggaaattaggctgttaacctcttactcctgctttctaggaaggtcaagtaacaactcagtttgggtttggtgacatggaaactcagcatgagtggctccattttgatttttagtctggtccgttgaggcctagtgcagtagcttagttcaaaacaatgacttcctacaatttttatttaaaggctataattgtctgtttgccttttcctactttcagttctatcagttttggcttcatttatttccatacttttttattgtatagatacatacatgcttaggatcattatttcctcttgattagttgacctctttattgttaagaaatgaccttggccgggcatggtggctcacgctgtaatcccagcactttgggaggcctaggtggctggatcacctgaggtcaggagttcgagaccagcctggccaacgtggtaaaacaccgtctctactaaaaatacaaaaattagccgggcatgatggtaagcacctgtaatcccagctacttggaaggatgaggcaggagaattgcttgaacctgggaggcagaggttacagtgaacaaagatcatgccactgcattccagcctgggcgactttatttttggttatattatctcctttgaaatcttttttgtcagatattaatatagccactccatctttctttggattattgtaaacatgttataaatcttactccattgtttttctttttatctatttgtgtatttacatttacgtattacgtatttatatttaaagtatgtttcttataggctgcaaagagttgggtcttgcttttttattcaatctgacagactctgcatattaaatctctagattttaaataatgtatttagctctttcacctttaatgtaatcattgttattgttgcattaaggtctatcatcttgccatacactttccatttcttctgcttttagtttctttaaaattttgtctagtgtgctttatattaaaagagcattttttataataaaatttgctttgttatttgttaattataactggtctttgcattattttgatggttcctttatggcttataatgtatatttttaactaattaaagttgtcctcctgtgatattattttacttcactcttcaaggtaataagctgtaaacaggtcagtatttatgtatgtatacacatacatatatacacatacatatatatacacatgtacatgtatatgtatatgtatatgtatatatatgtacatatatatgaagtgggatatatcagaggagggcaactgtgtgtgtgtgtgtatgtgtgtgtgtatatatatatatatatatatatatatatatatgctctacagtggtatacttctgtttctctatttctgacctttatgccacagttgtcatacattttatgctacatgttataaatcccaaaatatattgttataatttttgcatttaaaagtcagttatttttatttttatttttattttattttattttatttttttgagacagagttttgctctgttgcccaggctggagtgcaatggtgtgatctcggctcactgcaatctccacctcccgagttcaagcgattctcctgcctcagcctccccagtagctgggattacaggtgtgggccaccatgcccagctaatttttctattattagtagagatgggggtttcaccgttatggccaggctggtctcaaactcctgacctcaggtgatccacaagcgtcggcctcccaaagtgctgggattacaggcatgagccactgcacccggcctaaaagtgagttatttttaaacaaatttaaatatagtgtttaaatgtttatatatttacccaggtgactaccaattccagtgttcatcatttctttgtgtagatacagatttccacctagtctcactttttcttctgcttgaagaacatcctttaaattaccttgtactccaggtgtgcaagtagtatattcttccagctctaatgtgtctttattgcactttaatcttttaaatattttattattttctgggcaaaaagttttaggttgacatttcttattctatactgtaaagatgtttactaccttctggtttgcatttttttcaataagaatatgccatcattcttaacttttttcctctgtatacaacgcatcttttctctgtagatgcttttaataatttctctttatgattaattttaatgaatttcattgtgatatgccttggtatagttttcttcatatgtcttacgcttcagtttattgaatttcttgactatctaggttaagtgtttttaacaaatttggaaattttttattattatttcaaatattttttgttgtccactttctcagggattataaatatgggtagattgggctacttgaagttgtccccaaactcactaatatgctgttcaattttttttttaaaagcatgcatttctttgtatgttccatttcagatagttctgctatgcctcaacttcattcttcaaggtagcaagctgtaacaatgctaggactgacgtgtttatttttcatcattcagggatcaatgtccttcatcagtcaatgtccaatgtcctaaaaacttctattttatatattttgtctatatttttagtcatttcatgtgggaggataaatctcatttctgctgcttcatcacgttggaattgtaaacttttaaataaaataaattgtatatttattaaccattttatatgtctctttttggattgtccatttatccattatatatgcttagtttattttgacttctggtatatatgaacatatatatttgtttccttgttgacatactaaaattttgctatattaaagatagcagtctctgttcacacttgtttgaaatatttcctcagctgcttgaattttgttaaaatttgcatatgatgaggcaaaaaactgaagttctaaaacttggcaaactcttctcaaatgctttcttgggtaatttcttccagtgattttattatttagatgtcctgtttctatcaaaaggctaaatgagtatttattatgttttctctttatttatctgagtttaatagagatgagagagatgcatagcacttgtgaggtatggtgagaatttacttatatagtttcaaatagctagccagtttcctagctccgttggttgactaaatcaacatcattaacagtgataccaactaagaattaagttctcattcatttcagggtttatttctgttgaattctgtctttctgttcttatgctaatcttacagtcttttaattataacatgcttcattataactcattttaatatttttaaaagaattttcactctttacttctctctttgaaaatattcttggctcacctgttctattatctttgtttttttcaaattctcccaaaatatgcaactggaattttttaattaaaatttgtttcaacagttataataatttaagaagaattaaaatagtcacaagatgtagctttcatctgagtcagacaatatgcacagtacatttcttttatttctttttttatatatcctagtagaattttatagctttcttaaaatatgccaaatctctctcctgctgcttttatttctaactattgcttattatttgtgtgttttaatttttattgtaaattgtgtcattttctcagtgttattttctaactagcttgttgggataatggaaaggttatgataatagcatatgtagcttttagctggccactgtttattacttattaattatggatatgacttgattgaagacattaagcaactttagtttgaataattatcctcaggacctaacctcatttaatatataataattttaattttttttaagaattatgtgtaagtgctaaatataaaacaaaactcctagaagcaaaattttatggacatagcttctttaaaaacattaatcacagccgggagcagtggctcatgcgtgtaatcccagcactttgggaggccaaggtgggtggatcacctgaggtcaggagttcgagaacagcctggccaacatggtgaaaccccgtctctgctaaaaaagtacaaaaattggctgggtgtggtggcgagtgtctgtaatcccagctactcaggaggctgaagcaggagaatcgcttgaacccagtaggtggagtttgcagtgagcccaattcccaccactgcactccagcctgggcaacaagagaaaaattctgtctcaaaaaaaaaaaaaaaaaaaattatcacaagaactgaaattaagtttagttgtcttataaacatttttttttagaacagatatcactgtgattaccaggccaaaaaaagattaattcatccaacaaacattattgaatgtacactatgtgcccagcactttttttgaagtgttggaaatacagtggtcaaagagtagaagaaaagtctttctttactgaatttagttcagtaaggagagctatatggaaaacatgtaaactaaacataattggtgaaatacataaaatgtcagatggtgagagtttgattccaaaaagtaaagaagagaaataaataaggatgccaggattagagtgaatgtggccaatttagattggaggtaaggaaaggtatcactaggagatcatgtttgaactaagagaaggcaatgtaaggagataagaactatggatatctggggaaaataaaacaaacttaaaaatgtaaatgaatatgaaagcttcttaaaactttacttagggaggtaattatttgttatgtaaagttttgtatcttttcaattgagggagggcctctcagtgtttgagtccagcttgagtcacttctaaggtttaaagcttcagtatacattatctgcagaattaagatcctgcctccttgaggcaggattaagattctgcttcaaggcaggattataggtattgtgataaaatgtgagtgattatgttaagcgaattaatagttttaatgcaaaataatagagtgtaataaaatttatcttgtatttataaaattctttatttccaattaattcattgtgtaccacaagtgaaatggttcagaaagaattacacaagtttaaattcgcacagatcacttctttctttctttctttctttctttattttgagacggagtcttactcagtcgcccaggctggagtgcagtggcgcgatttcagctcactgcaacctctgcctcctgggttcaagcaattctcctgcctcagcctcctgagtagctgggattagccaccacacctgactaatttttgtatttttagtagagatagggtttcaccatgctggtcaggctggtctccaactccttaccttgtgatccgctggcctcggcctcccaaagtgctgggattacaggcttgagccaccatgtccggcccaaataacctcttgtaaaatcccagtctgtcagtgtatcccttttactatattcataaagtcatttaaagatgatctgaaaacctggggccacagcaaacataaattttgagtaaatggcattgcagatcccacctctgcttctccaagtccttctatctattgaatttagtttcctacatcatgagtatatttcttttaagaaggaaaattctaaggaaacattcctatattttaggcttactaaattaaatttaaaaataacataaacttgttaaacttttgtaagtaatgctaaaatgcttggcaaatgggaatgacaaaacaattttaatgaatagcaaaatccgatcacgggaagaccaataaaatgcacaatgaaaacagagcagcctacactgatgatggaagtttttgatctttattaaatcaaaagtagcctctaatttactacagacgatatggtgattcccattttttaatctacctgatgatatgcattgttttgaaagttgaaagcgttcttatatctacctagaacttatatcttatttttgccctcctctgaagtaaattttccaaaaactcttttgtgatatactattgcattctgtaaatacatataaaacaggtgagaggaaggcgagccattaaaatttaacttattttcatctggggctggtggggcacacctgtaatcccagttctttgggaggccaaggcgagtggatcacttgagcctaggagttcaagaccagcctgggcagccatggcaaaacctatctgtacaaataaatacaaaaattagctgggcacggtggcacgcacctgtggtcccagctactcaggaggcggaagtgggaggtctgcttaagcctgggaggcagcggttgcgatgagcagagattgtgccatgtacttcagcctgggtgacagagtgagaccatgtctaaaataaataaaattattctaatttttgccagtgtcgatttttgtttaaaaatcaattaaagaagcatttgtggttcaattttaaatgctataaatagaattttattcaacagcttttattatcataaagacttagaaaatatttggcttcattaaatgccaaattttcatatttacaaaaatagtaaaatataactccttgtatagcagcaataatttacattcctggttttactgaagaatcacatggggagatccatcaggtgcccattctccacagattgtgattgaatgtgggtcggggagagcactggcactttttttttttaaagcttcactcatctagggaacatcggctgggactaagaagatgtttccggtaggcacctttattatacaattatgcagtaataacttgttgtatataatgtagatcagcagcatagaggtcccctgagagtttattaaaaatgcacaatcttaggtcccaccccaggtctactgaatttgaatctgtatgctgacaacactctcaagtgatttgaattaagttagaagttaagaagcattgttgtgggatctacccctcctttggaaggcactattcctgattcctagagataatcaggctatgagagacatgtgaaactgagataaataaaataaaacaaaccaacaaaaacatataatgtcatcttatatatattatttaaatgtaacataagcttttatggactggaatattcattattctatcaatgttttcaggttatataaacaaacatcataatcagctgaaagtttgcttggccatcatggtattgttaatagaaccagaaaagttgcatgcatcagctaagatgtgtgatgcattcctcactatgggaagagtcttgcctacgggaaatacttgaaatctcttggctgcaacacccttcgcccatctttatgacagagaactaggaacaatatactggaaatgctccctctagggacaacactttcaagagctgtttccacttttgctttatgatacaggttcaacgtacctaatctgaaaatccgaaatttgaaatgctccaaatccaaaatgttttgagcaccgacatcataatgccacgcatggaaaattctacacctgaccctatgtgatgggtcacagtcaaaaatgccattaaaactgtttcatgaacaaaattactaaaaatattctatacaattactgtcaggctgtgtgtataaggtatattaaagcatatatgaatttcatgtttagacttaagttttcatccctgagataacacattatgtgtaggtaaatatccctaaattttaaaagaatccaaaaatcggaaacttctgaccccaagcatttcagataagggatattcagcctttagctatttactttcttgctttgcatagcttaccccaccttcttatttttctttcttaggtaggttaatacatttacctacctaagggaaaatttaaaatgggctacttccagattttgctggcctaagactgtctctctcaatgagaatgagcaaaggcactttgaagtagcttatatctatataggataattttctttccttcagttactaatcgttaaagctttgctcaagcttctgagtactatctaaatattccagtaccagaacaatatatgctatctcagtccattcagtaatgaatgactgcattttgaacttttatgtaccaatttttaaatgatgctccaaatacacataaatgaaattctttatttcttacttcaagagtttagtgacaatgacaataaaactataacctggaccacacttgagtcatctgaaaatctttcaaaagtagacttcatcatgaacaaactgcatcagaatttctgagattgaggcctgaatgttaatattttttaatacctcccaagatgttctgatttccagtagcataaagaacattactgagagtagggctgaaaattaatttctaaaacagatagctcagtaggtcatttttttttttcagcattactgtaattattaaaatctcctctggaacttttctagtcagatcttggtctacaaaagaaaactggacatcttggcttattaaaaaacatttcaagagggtattcaaaattaaacttaaacaataatttaactcatctatctgggaacattattcattatatcccattgctttccaaaacttagttgtgtggaatatagagaagacaattttctcctttactcttcatgagtttttagctaagattccctgcaacaaaaggcagattaacaggagaaaaacaagccgggcgcggtggctcacgcctgtaatcccagcactttgggaggccgaggcgggtagatcacgaggtcaggagatcgagaccatcctggctaacacggtgaaacccgtctctactaaaaatacaaaaaaaattagccgggctggtggcgggcgcctgtggtcccagctgctcgggaggctgaggcaggagaatggcgtgaacccggggggcggagcttgcagtgagcccagggggcggagtttgcagtgaacccagggggcggagcttgaagtgagccgagatcgcaccactgcactccagcctggaccacagagcaagactctgtctaaaaaaaaaaaagcaagagaaaaacaaacagaagcttaataacataaatacctcctttgtacatgggatagaaacaagaaaaatgggcagatctctagagtagatctcaaagaattgtcttatacctcagatgcaaacactaccattctctgaaacaaaggcataaggatgtaggaaaggttttgttaagaaagatgaccaggaaaagcaaaacacaagcaaagtttgtcacgcatagtgaagtcgatttcttctccattgattgagtcttcggttatgtagttattcttctcttcctggtgcggaaagagagggagagaaagagagagagagagacccttgaaaacatctatacatttcctttatagacataaatttatcttacacaagggaaacttccagccttgtttctagtattcttcctgtgtctgcagtttctcaaaatatctagctccaaataatcctaagccagagaggcatatttagggtgaaatagtctgagtgcagccttattttggggtgacatgttctgaactctataagaaattaaaacaatctaaatttttggtgagatattttcaaaatttcattatttcttaattctacataatcatcattatttcagtattttattaaattagtggaaaattacatgtgatttaataagtgctttatttccctaacctcaaattatttggggcaatttccagatgtatagtatgaaatcatggagcaatatttgacatttggtgatgtaattaattttatattttacttaaggcttattaaaacagctgttatataacaatttaaacaaatgttcaaaaatcttaattgtacaaaatgattttggcttttttcccccaagcctgagacattctgatatgatgtacagtaccaaacattgatcaaaagctaaaaatgtctccaggcatagttgttatatataaatttgtgtgtgtgtatgtgtgtgtgtgtgtgtgagatatatatatatatatatatatatttttcccccccagggttatggtggctatattgcatcaatgatcttaaaatcagatgaaaagctttttaaatgtggatccgtggttgcacctatcacagacttgaaattgtatggtgagtactttctacagactgacctagtataatgtattgatttgtagaaaacgaaagcccaatttagaatagctcaattgagctcatttatcatatgttattagagcctgttttcagctgtttatctcctccttgattcagctgattttactaaagcatgacaattaaatgtaaaatgaagaaattaatgaaatatgccagtcaaatagtttttagtttcttctcgaatgtctgttttcttgggtcacagcctcagctttctctgaaagataccttgggatgccatctaaggaagaaagcacttaccaggtaactaatttgaaaataacaaagaaagaggagtatttttgttctaaaaaattagttaaatggcttatttagatctatagatacagatatttgtattttcctttataggcagccagtgtgctacataatgttcatggcttgaaagaagaaaatatattaataattcatggaactgctgacagtaagtattatacttgccgctgctgtttgatagggtatgaccttttacaaagggatacatctaaggacttgcttacaggaagccctgtaaaccttctgaagaagggagcagagagtcacacaaagaatcagatacatgatagaaggtgggaaaaaagaattcagagataagaggagaggaggctattcctcaaatggcagcgttgtccaatcaaactccctgtaatgatggaaatactttatcaatgttgctgaaaaagtagccactggccacttgtggccataccttgtttagtgtgactgaggaactgaattgattttatttaattttaatttaaaaaggcacttgtgtctagtgactatggttacagtgttattcagcacacctaaaatggaaaccaacctggaaaacagaaaccaaaaagctgcaagcactgacatgaaattctaatgaggttacccgcttaaatgaacttaaaaactttaaaaaggcactttcatatcatctctcattttttcatcactttaaaccttggaggtggatgtgattgatgttagtagtaataaataatatcattttatatttacatgacactcttagggaccaaagaatctatattttattatcctctgtgatattttacaacagacagctgaatatttatagcttcattcatggatgagaaaaatcaatttcaaaaaggaaacagatttatccaaggccatctggcaagtgagacaagaaagtcaaagtcttgaatcaatatttcctaaatcttgaacttaacttcttcctctttagggtgggttccactgaatgatttgcttcaagggtactatatggaaaaagagagaaagaggaactttacagtggagaaatttgacaaacatcacatcaacagtgacaagtcatgttattactgttattaaatgcccttgatatgatgtagtggggatggcactttacctccatggtttagtactccaagcccatacataacaccagtctaaccatgagaaaaccatcaggcagatccaaatgaggaaaattctatcagatatccagccagcacccctcagaactgttggggtaatcaaaaaaaaaaaaagtctaagaaactctcatagaccagaggaagtttaaaagacatgatgtctaaatataatgtgggattctgaatggaaccctggaacagaaagggtacacaggaaaacaacaataagaacaccaacaagaaaaactagtgcaccccaaataaagtgggtttagttagtggtagtatatgagtcttagtttctatttgtgacaaagtatataataatataagatgttaacaatggggaaactggaggacgggtatccaggaactctgtactatctctgcaactgttctgaaaatgtaaagcaattatagtattaatagtctattaaagaaagaggtagatgatacagtaccagtgttgggtgaaacatgatgaaagagagcgtaaaaattttgagggacatttggatgttgttctaaggtattaagaccttacatatatatcaacagtaataaaaataaatagcaattatgtactcattgtatgtcagaaaatgtgctaaaagcatttaatattatcttatttgtacttcttgcaaacacggaatagtagatgttattactttcatttaacagattgggaaaataaatattaggaaatgatataacttccttaaaagagtagacacaattgattagtaggaaggagatttgaatccatgtattgagccttttattcactgtgccctgaagccttattcatatgaataaattatattcaaggttaaattattgtatgtctacccatcatgctggactaatatattagtgctatttcaaatttctctgtcaatatgttgtagctataaaggtaaatcattgttctatctgactcactcagtcacaggcctggcgcttcacccatctaataaaatacaagcagaggttcagccctggtccctggagaggaaatgcacctgtgaatgtgtgtgagcacacacacacataggcacacacacacaggcacacacatacacataccacacaacccatacgggcctggtgaattataggtgctcagtcatgacactgtaacaccactactattaatattatcttcaaaaattaccagcaaatgaattcaatcacccagtcaaacctgtaatgttcccttttagctatagtaaacagacaaatagcaacaaatatcaatggactttgcattagaaactaagcagaaaaaaaatccaattggaaaaatccttttgcacatttattttcagctgtctccatgcagacaaataagggatcacattacctctgtcattgaccttattaattagcatttctagaagcttacatttatagagcagtttgtacttatgtagcaatgacaaggtcattttcccattaagtgccataggaagatgttgaaaaagatcttgactatctagttttttaataggtttaaatgattgtttgccattttacattctctgctgtgtggtctgattattcagcattctagagttagagcattaaagaggcttaaactattgataaggctgccctaattttgcaacgacaattaaaaatgttagcttaggctgggcgcggtggctcacacctgtagtcccagcactttgggagaccgaggcaggcagctcacgaggtcaggagtttgagaccagcctgaccaacatggtgaaaccccgtctctactagaaatacaaaaattagctgggcatggtggtgcacgcctataatcccagctactcaggaggctgaggcaggagaactgtttgaacctgggaggcagaggttgcagtgagccgagatcgtaccactgcactccagcctgggcaacagagcaagactccatctcaaaaaaaaaaaaaaaaaaggcagcttaaacatgagttacagaaatctgaagatacacaaactacaggaatgaacaccctagacagaatgtgagccaacttctgcagaaagagatttgagtgactgcaccaaatcttcatagctaccaaacccatggctattgggctgcttacttcagaatcttggatcttaggttctggcagaaggaagataaagcaagagtaaccagtatgctctatattaaatagttagtccttgtataatgagatgtgtattctattttctcagtatggggtattcttttctaattttgaataataaagcagaatgccagtatccaactgagactgtgccctagtaatcttcaaaatgaaatagatagctggtttcctgtattaatatccagaaaagacatttgccatattaaaattttttataaattttataaaatttataaaaatatgtgtaccattaggaataataaatactatccagtaaagtaaatataaacaccattctgtagagtaagtaggacttagttgtagctactgttttgcttttttgtttaatagagtgaagctcaaagttttaccattgtatttgtatttaccagctttctacctaaagccagatataaggttttttggttttttttttttttttttttttgagacggagtcttgctctgtcgcccaggctggactgtagtggcacgatctctgctcactgcaagctccccactcccgggttcacgccattctcctgcctcagcctctcgagtagctgggactacaggtgcccgccaccacaccggctaattttttatattttttaatggagatgggatttcaccgagttagccaggatggtctcgatctcctgaccttgtgatcggcccacctcggcctcccaaagtgctgagattacaggcgtgagccaccgtgcccagccagatataagtcttttaaatgtgcaatgtatgtaaaataaaacactgaatctctttgaaaaataatatgaaaaagttctcatacaagcagtgtgtttcttcagatatcataatttgatttcttgcagcaaaagttcatttccaacactcagcagaattaatcaagcacctaataaaagctggagtgaattatactatgcaggtaagctactttcttagaagaacgtgttttcctgctgtgttttttcacttgtgagatacgcaacacagcttctctattattccattctccctactattattttttaatatgttttttagttaccaaagattgtgttctctgttcctgattacaccgagaatgtggatgaactcatgctttacaagtgaattgcatgaatcctttctaaattgtcattttcctctcagacttattcatatcccaaatattgaattcttttaaaagtaacaagtttctacttcccttcttgttccttttatcttttcttccttttgttgttcctttcttccttttcttgttccttttgtcttgttcctttgtctttattattaaatatgagagtttattattaatttatttttaaatatgataatttataattctcataataaatagtggataaaaaatgtttggggaaatattacaagaaaagaagagaggataaaaggccatttgcactaccatttatgtctgtgcattcatacatttaatatatatttatcaaggacattacagtggtcactctgctctatgagtaacaagacatacattacactgtcaaggaggttccagtctgatataagagtcatagaaggaaaaagtaaagtcatttaaatttctcagcattcagaagaaccaaaagttgctcaacctgtctaaaacacaaactaccacgtttaggataatgaaatatgaagctatacagataaacaaatgtcaggtcattccataagcaatgttgaggagtatggagttttattcaaagggcaatgaggcgccatttaaacctttgtactcaggaattaatgggataatatttgtattttttatttgtattttagaaacagtaacaattttgtttacattggaaagggaattgtcaaagtaaataattgcaccagacaatgttaaagaggcaaggaagaccttatgaaaaactactgcaaaggagacaaagactgaactcaatgctctttaaataaagagctggaaagttttctaaactaaatactcctaaaaaggggaggagaggccaagggcctttagtcaaaaagaaactgtccaaagtttagtcaagctgagggcaaggttagtccatctcagtcaacataaacatgaaaaagtctaccttttatggccaacatattctaatttaaataccaaatattaattgacatgattacaattgttttaaaagtttagcatgaataacttagagtagaattaggtttgattttggtcagatattattactcaaagtttccatgacgttagggctcagaaaatgaatgcgagagacaatagcttcttggataatttgaaatcttctttctcctcaatatcttaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa

SEQ ID NO: 1000 - DNA, 682814 bp, Homo sapiens
cgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccagcttattgctagcgtgggatagagggagcgcacgcggctaggctccagcagcgactcggcttttcgcgtattctaagcactgaagagcctcttaaggggagctgtccaaatcgcccaggagtggtggcgagacacaggaggccatgccagcgatgctgttattaatattgcagacttggtcatctctcctggcttgcggtttcttttctcctcttccctccccttctcttttctctcacatgtgtttcacacaggtggtggggattactcaatgacttacagctcccttctcgtttattagtgggagggggttgaatgttggcagttcttacaaagcatttgttttcttaaacgatcctgtttgatccatactctgagataagtatgaaaatattaaaacatcatacgttccttccttttataccccttcctcctaatccccagcacacatcagaatgtaaacattggttagcagatatagaaaaataatttcagaacgggaacatggattgaacatcctctttcaggctgacagcccttaaatttcattaacaagccgccgagcctctctactgctctgggaatgatgctaccagtaagaaagattagccaggtgagagtccccacatgaaatctttgctcactaacctgtgacaccagctggttacttgaggcgctgcaaacagttcagtgatggtggaagtgggatgcagaagcagagcagagcagagcacacaggagctgaaaatgtatgtgtagatagtggacacgctgtctatacacaacaaatccccttgtcaggattaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaactatacaagtaaatcacagctctgctaattttagttaatatcacgctactgatctaaataatataaaagaacaagatagatcctcataaatttataggagctttttttgatctttgtatcatttgtctctgatgacgagactctcaacgtttgttaaatgagtatatatatatttttaatggtcaatcagacaaggtttagagtttgttcacatttccaccaggtggcacccttctgctgactccagtgggtaaaaatattgcctaaaaagcgtggctgttctctcagctccaaaagcaaaacaaaaataaccacacaaaaacaaaaacaacaaaaacaaaaccatcccactttttagagtatgactaaaaagcatatttttaaaagcaactatttgactacaaagacagcacttgttatgcattttctttaaaaaaatgcattttggtaaaaaaccaatctcttacaattgaacgtgaagctgtcacttgatgaaataattcatgaccagaattgagatcaaatgtgtaatgtgtaaaatgccttctctgaaatatcgatgtgctttagacatttaggtaatatcaacttaaaatgttttaatacagaaattggtattcagtatttttattttacctttggtctagcaaaccagattaaatattcaaacatatgcttaatgaaaaattgcaaaagagttattcttccatgtgccctttgctaatatatacacatcataatttgatcaataaactattgtttttaaaacacaaccatgaaaagagctttcataaatcatattgaaaaattttaattaataaaaaacatattacttcgaattattcaacatataaaatgtcatatttaattgggagtagagttctatataatttggttataaaagataatatacattaaataaagatgttatatggaagtctatgatttgagagaaaatatgcatttcctactctccctgaatttcttatttttatatgtaaatattatatattatataaatttataatataaatatatatataaatttataatataaatatatattatataaatttataatataaatattatatataaggcattttgtttattaagaacatacaacaaatatctcttgcttagaatcttctaatatatctatatatctgtttgattatttcaggatctgagcaaatggtacattttaaaaagattaaattatataaaacaacttaaagaaaattgtattattaaatatcaatgctgcattatcttatgaagcacattacattggaaacaaaacaaccaaatttctcccagtctcagtaaaaataaagcaaattcaaaattttggtttcttgaattatttatgattacagaatgtcttaagctttactacttataggcacattttaaatttacttacagtgtgacatgtagcagacacaatgccagaatgctgtgactaagattgtgagattttgtgctatcaacaacaaatatttattcatcactgtctatgggttatgcactggaagtcacagagtcaagttcatatcccaggtccgccaaagaccagtgtgttttcttgggcaggataactgaatttccccatttcacctgtgaatggaggtgactgcagttccctttagatgtttgttctaacggttaaatgaaataatatgtaggagtttttgaataaggtctgactcataccaagtcttcttattaaatgtgtagtctgggaataagagcctagacaaaatagaaaaaaaaaaaaaaatctgggcctggtgcagtggctcccacttgtaatcccaacactttgggaggctgagatagatggattgagcctaggagttctagaccagcgtgggcaacgtaatgtgactttgtctctaaaacaaacaaacaaacaaacaaaaaacaaaaaagaaaataaaaagaaaagaaagaaagaaagaattatcagggtttagtgacatactcctgtggtcccagctactcaggaggctgcggtgggaggattgcttgaacctgggaggtcaagaccacagtgagctgagattgtgccactgcactctagcttgggcaacagaacgagaccgtctcaaaaaaaaaaaaaaaaaaaagcctcagattattaagccgtgtatagctgatccattattttaagtttacagacaaccatattttgcagtgcacatattagtatgattacacatgagtttttgggtgcatgcaaatattatattaatggatttggacatcaatcctattttggcaggcatccagatttcaaaatattctgttacatcctgactttcattcaatcaaaattgaatagtaaaattctttactgttctactctgtaagaagtcaggctaaaagtaaactttggctaattctcaccaagagttgaattagctgctgaatatgttgcatattgttttcaatgcaatgtacttcccaaggtaatcagcatgagaaagaggatatttaaaggaaagacagatgggatttatagaaatatgtcagggggtgagatttcagtcaatgtagcaggagagtgtgcttggcagtggagccaccaagaacccagggtgcatgtccctactgttatggggaggggcatggaattggattaaacataagtcaaaagactttttcacaaattttttctacacctttttctgtgtaacctttaaacacacatgtatgctccacttattaaaatcatctccatatattttcatacttgctaagtgacttgtgtgtcctaaccaagttcatgtatgactaacattagaatgggggccatatactaagacatacatcaaccaaaaaaaggttggaggtttttccatctgaagacttgtgcaaggtccaaaaagaagccagataaatgataaagggactgtaaacttcttcataaacttatatccttatggatagttagaattgttcttgctctagtgaatgctgtcctgccttgagaagttgtggagtttagtattgattattcccagcatactcttgttttaaagtttttattgacctgatccacaagttttctggcaataaccaatctctgtttatttgtccctatctaatagcacctgttctctaaggcttttaaaattagcacttaccttctttctacacggtagacattcttatcattgactacatattaactcaaggaatggttgtcgttttcagtatagtagagaaggctgggaagtaggttcggtggggagactggggcactgaaaagaaagctcttctattgtagatttatgtttgttaagctttcctaaattcttagaatctcaggcatatccatttgtaatggtaaatgtgtcatccactgccaggctaaatacagaaaactcacttttatccaaaactgataaaataaatattttgaattgttctgttctgtaattgatgtgaacagtattcttttaatgtcttccacaaaataaaaaaaatttttttctaagtttttcatgccatagtttatttaaaagttattaaaatattctataacatttttggaattgccaaatgattttcaaatttaattacattttggggagaggcaacgtgatgtaagactgagaacaaggtcaaacagatttcagattgattccttcctctgccatttactaggcaatttataatcccactaaaatcattctttcatcttgaaaagggagaggatgatgagaatgttgcaataattagagaatctatgtgaatgagtttttattgcatctggctcaagcttgaaacctagtaagtattttcattcttaatgctatcgtgcttctagatcatctcagaaggatattttcttcttttacaaaagtaaatttgcacttatgtgaatgaaaatgctgaatatgtgtgtgtacaccattatcaaatatatacacactatacacacacatatatatatatttatgatctaaatgctatggatcttttataggtagattattatagggcgttagatgaaaatgaattcgtgacaacttgactgatttctactatttttagatgaagagtctattttcacaaaagacttagagtcttgtttgatatgttcatggtttaatattctctttccagaagtttggtgcccaggaatgatttacttagaaattctttgcatacgggaacaggtgatattatttagttgaaatttaagaaaagttagttgagtgcataatcaaaaccgactttacatttgggaatgttctccagccaagctatgtattatctaactttaatattattgtaattcgtcatgcttactggttttctcaggtcaagacaaaataactatgtatcagattataaaagatagcaaatgaagaaaagggaggataaaagctatttttattattcttatccccactctctttttgatatgtaaatgaagattcagtttcttattccatctgagaaagtctgctctgaaaacagaaatgtgacaaatctgtattacgtaatcaagaacttgagtggcaggctgccctgtgatttattttcaaataatggaccagagagaccacttgaagttgcattaataatgcttgtacagggagaaataggcctttcttgttattggaacatgggtttacttttggcaagagttgagtaagtgaaaactctgatattcatacttacattaatcacatctcacctccaggaatggttttaatgtaagttaatcaatgcaaaacatggctcttttttttcacttcacatgttttaaaacaagtactagaagtctttcataaagcaatcctttaaatcaatgtgtcacaaatttgcattgataattcttctctcttagacacagaatagaagatgaggaactgagacaatgtttgaatagaggtaaaaatatatctttttgagaggaaaaaaaactgaaatccatgaaggattcctcaaatttagaataggtcatttgtctggcaaaattagtctataatttaaatttcctaggatctatgaaattatgaatagattttctatctacctcactagcttttagggacttcaagggaaaagacgatacgtttcacctgtatgtacttttttagagtactataaaacataagtggtccaataaataaagtgaacatattttgaagccaaacccaacatcttcatcagggttatttctttttttctgatcttaggaattgtgtgtaccctacttcttgacacccatagtgagagtgataggcatgtgtgaattgaaccagaagttgaaatgaaagaaactcccctccctcacatttatgaaggttgcttataattgctccaaaatgagatttgctcaactttaggccactgtggcatgatgagtggctcattattacacatttctatttgctcagcgtcagtatctctgcactctaggatggtacttctcgttccttcatctctctttgcatgaatgccatctccaaacccaaatccagttccctccgcctctctacatttctgagagccatcgtctgtctaagagttgattgactttctgagaaagaatactttgatattggctgggcacagtggctcgtgcctgtaatctcagcactttggaaggccgaggcaggtggatcacctgaggtcaggagtttgagaccaggctggccaacatggtgaaaccttgtctctactaaaaatacaaaaattagccaggtgtggtgccacatgcctataatcctagcgactcaggaggctgaggctggagaattgcttgaacccaggaggcagaggttgctgggagccaagattgtgccacttaactccagtctgggtggcagagcgagactccatcaaaaaaaaaaaaaaaagaaaagaaaagaaaagaaaagaaaaagaatagttggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaaaaaaaaaacaaaaaaaaaacaagttttaaaatgctttgtgtccataggcaaggctcatttgacatttcttgatttctcctttgtgatgtgctagttctaggtcagtggtccttagacttttggcacctggccaccagacatcacagaagtgcatatgcatcttctgtactttgccatggcaagaggttacacgcaaagccataatgccattctgaacgtaaactgtgaaattcactactccagtgaaatggcagtgccaccactacacaaacagagttgactttctcaagcttcccctcttacactcagcatgaataagcaactgctgatatctacacacagcatctgaaattgcaactcccagcaatgtagtagcaattgggtgaatccctcctaaaggagagatgctcttaacaactggggaatgcatgcaggtaaattttagagctttcttgggacattaatggaaacaacagacttctgatacactgggattcttggtaagaaaggcttctcccccgggcgtggtggtgggtgcctgtagtcccagctactccggaggctgaggcaggagaatggcttgaacccgagaggcggagcttgcagtgagcccagatcgcgccactgcactctagcctgggcgacagagtgagaatccgtctcaaaaaaaaaaaaaaagctatttccagaagctgattatttgtatttccagacagagttttcagagcaccaagttccaatacagaccagagaaatgattatatgctaaataaataagtccatgaggataatttttcagacacatgtaattatttttagtggatagacccagggatttctactcatttaacctgacgttaaaccctagaaccttgacatactagtttgagcaacttacccagcctctctgtatctgatgcttcatctgaaaatgaattgatgtttattttgcagaactgttgtgaggatcagcaatgaaataggtttactatccaagaggtgctgaaaaatggtggtgcttattatttggttattaatatgtgttgggttgttataccggacatagacagagcgatggaaaatcaaactatgttggatgttgaagttcccagaagttggaaacacagctttaaagcaccttttgtcattgtttgacattggaagcttaagggcatctttaatattgagctcctgttttggttggtatgcagattatatagagtcctcctgactccaaagcaaacatggattgggagttggttaagaagctgcatggcatccatttttatatttcttatcacgcagagaagttgacaaagtttatattttgaaaatggaaaactgaatatgcatttacttttctgaatttgttttttttcccttccccatccccatggttaaattccgtctcatgcttataatgtattctgcatttggactgcagcttcgttccttctcagagctacagttcttgagctgtaacagcgaatccaaaaaaactaatatggaatcacagatggtgcaaatatttgaaaatagataaatacaatctaggattagctgcttggactcagaaatgtcagcttcacattgcttattggtcacacaaggcaattttagttaaggaaaacacaggacaaagccatcatgatataaaattgctggtttgaagatgtgcagcataacaagcccataattgttatgtaaacctcaaaatgagtcattctgtaacaagaaaaaggtattttagagagatcacaaagcaccaacaggttatatagggctaaaaaattaagcagataccataactcgttcctgttgtacagtaccatctgctgacttccatttacagccaatttttaaggagaaaatatctgttctaatgggtatgctttaggtaggcacatattaaatgacctgagcatgagatgcaacagtcaaattgccagcgtaaaatctgcagatggtaattattagtaacatgcactgtgggctcatagttctgactctgagagtcttaaataatagaatcccattttctctccattatccccctttaagatgtacatatattctgaaggaatcttacaaccgactatgtgattaagttatctggtttactgataaggcagttgagaacgataaaggctgatttgctcaaaatcatacaactgatcagtttggtacagtagaaagaagagttcctcccacctaggttaagagttggtagaaggagcctcactcaattatcagaatcatagaaataactttggattgtctgtgatgatgtcgataaagaaaaaattgatgagaatgtaagtggaaaggttccagctggtttaggattttatttttatttttggtagcaggtttaataagaagatgtattgtatagattctatctgaaagcaataaggttaactatcatggtttgtgtaaagtctaggttttctgcagtatctcattttcctgatgaagtagaagagagtaggaagacccgttccagatcagacatgaagatctataagacagtattgatcgctttcaatgtacatgtttccaaatgagaaaatgtggttctcgtataagtatgtagtgaatatttgtcaataatttaacttattaaaggagccatcaagatggtaaagttggttcaaacagtatttgaggaagagagatttatatagtctgaaaaggaatggcttacaaagtttccaaaattaaatacaaaactggttaatattcaggccataacttttgtgtttgtctttgatagcagacagaaatttttgggtacttatatattttctataattaacatctaactttatagactgtgggcctatgtaatagcaaatagtaagagaaaatagggtacattcccctaaaattctataatcatatgtcggctgattagatagtgccccagtttgacattgaaaagatgaatgtatagttatacttgtttttatttacagttctcgaattgttttcttaacattcccaagctcagaaaaattgtgcaatctgggcctacacttgatgtcacagccaacttcttaagtcatgttattaaagttttctgtaaaccctgtggagcttccagtgtcagatttgattcaccagcagtgaggtcctggaatgcagccagtcagccaacattgcttgtcgggtttgtcccaagaaattgatgcaggtgtctatgaaggctagaggagaacaatttggtagtctcaaatagcttttctttggagaagatgagataggataattgcacacaaggaagtgagaaaccattcttgaaggatttagcaaaatgagattcggatcaagctgcgtggtggtagttgttcctggagatggctacttttagaaactgcccttagggagaagagagattaactaccaacatggtgtgatttaaggcatatcataaattttcattcccttgtgactcgcatctgtgactgtcagtgctctgaaaaatagctcttctcattcatctgtgtagctctggattccaccatgacttcctttgttcctttaacttctggctgggcaggggatattaacaatttatgtctaacttgtatcatttcctgctccgtgattgcttggtatgctctgtcttgagaacccatatttgggggccagagaagatgaaggtcttatgaatttaagaggggtgggggaacaggaagaaataaacatatgaatgggattgggaacctcaagagagaatcaccacttgcacatggggcaagctacttcccttcccttgccctttcctaccagtgttaaaaacaaaaaaataagtttacatgagtacttctgtgcagtgtaaaaaggggttcaatgaataatttggagtttaaaaaacttattgaataattgaaccttagtttcctaaaatatcttttactttctcacagaaaagaccagcgctattcaatagtacatactggaaagatgaaaatgttctgtattggtgttttccaatatgataaccaccagctacacatggctatcatgtttaaacacttgaattgtgacagtgacactgaagaattgtatttttaattgtacttaattttaattaatttaagcttaagtagctgtatgtggctagggctactatatattagagaatcagttttagaacactatccaaactttaatgtgggtatgaatcacttggggatattgctgaaaagcagattctagtccagtgaatgtgagctggggtccaagattctgcatttatagcaggtgcccagatgatgcctagtctgtggaccacactctgagaagtaaggctttatttctcaaaagcaaggattctctaatcctaatttatgtctttagccaggctgacacttgtcctagaggatgagtcagatgagcctgtagcaaaattacaaaatatgactttcaaattataaaaggaaagaatttcagtgacaaaattattagtatttttattattgacagtagctaaaattttgtgtctatactatttatatatgttgtatatttatattttatatattttataaaaaatttaaatatatttatatataaatatatatttgttatatataaacattttatatttataatatttatatatttatattatgtaatgtaatcaattgcttaaattttatttaatcctcaccataaccttatgtaatagattccacttttattccagttttgcaaatgaggatctgaggtttattaaagttaagagactcccaagactccacaggtagtaaatgcagaagttgtcttttgatcacatacagtcatacatattataataaccatcaacttctttcctgttattaagtggaggccaatgatttcccacttgcggctgatcaataaatcatatttgattcttttctacaaaggataatagtaagagccatactagtagttgtagtagtaatgctcactagaactctgtgtacaagttagaactgtcatcctcacttcaaagatgaggaaattgaggttcagagagggaacctctttggttacataatttgattacgaccacataacttgtaggtaggtggcagaactgggttttgaacctggattgtctgcctctggagtccatgcccttgtctgttccagtagacagtttctcatgtgtttggtgagcacctgctcccttaggcaatgcactgtgagcatggctactgccttctgtatattcaattgaaaatggagtttactttgaaaattttaatcatgtataattttatgtctatcaaaaatattttaagacaaaaagtcactctttattgtccaaaatgtataatttagtttgtagcatctttgaagccagtttttaaattcgtttgtcatccatgaagctgactttttaattgtgcatatttagttttagatcttacctccacttttttattagtgaagaactggtgagcactgtaagacatgtacatgtacgtgtgtgtatatgtgtatatattaatgtaaactttacaatttagaaaaacttaaaattgtcttccttgtctcccgtaatgaacttgaacgacaaattggcttcatcattttatgaaagagaaggtgaatgctttgctcccggtttttcagtaacctaagcatctgatttaagccttatttttcagaggtctttgtcattttgtttagttcggcagtcggtgctaacggagtctatttttttcacttccaattttaaataaaacacacaatcttctttaatttctgaataacatattcatgtagttcaaacatcaaatattacacaaatatatacagtggaacgtctccttcccagagttgttccccagctgtgcagctcctcattctgtcattcttttgataggtaatcactaatattattttcatttctttcttccagagaaatgtttgtagtttcaagctagtctagacacattctttacctctccttttataaaaatgttagcagacatgtttattttgaagtgtataacattgcttttgttttgttttgtttttgtttttgtttgtttgtttgtttgagacagagtcttgctctgtggcccaggctggagtacagtggcgcgatctctgctcgctgcaagctccgcctgccaggttcatgccattctcctgcctcagcctcctgagtacctgggactacaggtgcccgccaccacgcccggctaactttttgtatttttagtagagacggggattcactgtgttagccaggatgatctcgatctcctgacctcgtgatccacctgcctcggcctcccaaagtgacattgcttttttttgataaaaaccttgatattatcaaaatagaccctctaaaagttggcttctttaaaaaatgttcctccttttttcatgatgaattagatattatgtgcctcataatctgataagtgatagccagtcttggtgcaggtgtgtttactgtgcccttgcctacaaacagaagggaagagccatgctctccacacattgcctgacaaagagtaggtgctcattaaacacctgagacactgtctaccggagtagacaagggcatggactctaggggcagacaatccaggttcaaagcccggttctgccacctagaagttatgtggccctagtcaaattactttccttctctgaaccacagtttcctcatctttaaaatgagaacaacaaactaacttgcacacagtgttctaatgagcattattactaccacgactactatgaataccactactgtcatctgtggaggagagtggctactttactggtcaaccacaatcagcaaatcattggcctctatttaataaagaaaataaattgatggttattatgatatgtatgattgcatgtaacctaaagataactactgcatttattagctgttctgttttgggtatcccttaacctctctgaacctcagctcccaattagcaaaactggaataaaagtatttgatatgttggcatccacttcaatgctatatctgtgcatgtgtgtatgaatatgtatgtatatatacatttatttatatacatgctttccaacttaggatgaggttaggtcctgacataaccattgtaaatcaaaaatatcatcgggtcaaaaatgcatcataaattgaaactatcataagttcctctacctattatgggattgtggtttctactggatgtgtatggctttcacaccatggtgaagccaaaccatcataatcgagggaccatctagatagcattggtctacatatgttaatggggatcttaacaaattaaaagtagaaaagcttcctccttatccccagcattagactcaagtatgtatcccagcttttgcagattttaataagttgaaaataatgaatgagcctttcctagtagatgggtaaaagaaaagggctattattgaaatattctgaaacacaattctataccttataagatattcatgttaaggaaacaataaaataatatttagaaattttaatgtagaattgaacaaattccctctattttcttttataataagaaagattatattcctggatgtttgaatgacactgtgaagtctaaaggctagtaatggacataatcccgcattattaaaatgttgtttctgtattattattaaaaaatatagagactctcaatacatgataatgaatacgtggtgtgcttacgttttcttatataccgtgggataagcataatttgagaaatgagaggcatttctttaaacaatagactgtgctttattcacctgtcttagtctaaaaaggctatatgttgctgtcagtcacagcaaaccaccctctcagtgaataaggagataatagtatttgaggtaaggatagaagaccttagactttgcagaattcttttatgtttgcaaagaaaaattacctcgataaattataagcttatggatttttgtgtccttaactcctcatatattgaggaagctaagaattattctaaacttggcaaatttatttggtcaaaatattcctctctattccatcaagtagtaatggaatttaacaaacacaccaggaagaaaaatagcagcattgaaatgttttattgatccgtaaggatgaccagctctaccaagactcgaaaccgtttcacagaaggaatttttagttaaactattcttaacaataggaaaaacaagttatttcttttaagattctgtagagattatagagctttttaaaatcaaataacctcttttctctgaaaaattttaaagaaaaatcaattttttacaatacacctgctgaattattgcagggcatatttggtagctgctaatcttttaacacaaagaagaaacttgtagttgttaatgcttctaggaagtcaagctgctgaatggaaagtggtttttagagttcagattaggctttaatctttgatgtcctgctgggaatattaggagatgtatgggcatggttgaggagaggtacactgatagaaatcaactacgactttgataatttttttcaagaatcttattaagtaacccagacagaaaaggtacatgaaatgttaccaggcagattcctgatttcatattataaatactgaataggtatgacttgaaataaattttaatcagtcactacttacatattcgtacctaaaatttgggtaatggtaccatttgattctatcataaggaatcaagcctcttgtgtgttataatccaggatctttaggtcaaacctcttccttttgtgaattaacctgaaaatcctgtcagatcttctaattacggtgatatagggaagtttaataggaagtcaggattcccttgacctctgagatttcagtgtttggcggagtaccaagctctctgtttcaccagctactgcagagtcttatgacatacccaatggttgaattataagttatgcccctgaatacatctaaccatgacatcctctcactagaaatgtacatatgtatgtagatacccagactgatgctccaaggaaatgtttctagattgaaagggtgggagtgggcatgaaaaaatgtcctttctgcttatttatctcaatgtccatggaggtaactatttataatggaaggactgagggtaaccccaagaactcttgattataatgatgctctctccctccctccatgcctcccttcctcctgcctccctccctttcttaagcaaaaaagcaacaggaaataaagaagtgaataaaagttgtctcttttcctaaaaatatacgtcacttagtgaacacatctcacccctattttgatttacgaataaggacaacttaaaaactatcttctaatatgaaacaccttaacactaagaccttgcaaggtgcatctgttctttttatcctggagattaaaaaataatttacagacaaacagtttgggtgtgaaaatacttaaaatgaacaactttcattatcttttaagaaatcatgacggaagttctggtgaatgtctgtgctaacctgaagatattgagaaagtattttaggcagattctgttttatctgttacttcatatcatatcactcccttattcggtggcttaaaacaacgattttatttctcatgattctgttggtcaggagttcaggtggcttggtgggcagtgcttctggttcaagtgtgttgtttatcttgactgcattcatccggtagctggaaggtcaggaagacttcactcatatgtcttgtatattgttgctttttcatatgacctctctttctttctccacatgggtagtttgaacttcttcatagcatgggtcctagcatctcttaccaggaagttgccttctaaaagggattattccaagtaccgagggaaaaaaacccctgcagatctcttaagaatcaaccttaggagttatggagcctcttttctgccatatttccttggtcaaagcaggacacaggagcagcccaaatacaaaaggaggaaaaatgaatttcttgtttccataagagaaatggtaaggactgtgcagtcatctcggatccaccacagactatcattggctaaaacaacagaactgtatctggatacagacattcactataatagaagcatgtggatgatttaagaacgtttgaatgttaaaaatattataaggataaaagcgatgtcatgatgtcagtgctgtattcagccataatttttcaacacataccgttagccataatctatcaacacatgcagacaagttataatttatagaaaacagtctttcatgtgcagtgatgcttaaaaagataagaatttacattttcactgtaaaatagaaataaatataaagcaatcacctttatatagatgtagttataaaatatatttatttgagaataaatctaatgtaccgcttggttgaaaaagatggtatattccaaataatcttttcgcttcagggaaattatgaccatctagagtaattttgtgtcaaaaattaaaatatacagctagacttctcagaagatgtgtattttaaggaagggacaagtacacagaagttggttattatggccacaaagatactttagttgtgagatataattacattaatgaattctgccactgtgaaatccttgatgttgtcacatttcaggctggaagaagtaattgatctgggattggtgggattccaaagatttcacagaagaaagctttttcagatggttgggggaataatcagggaaaacagtctttggggttatcaggaatataatataattctctatgaaatatctttttaaaattattccagcccctctttgggcattaacagtgcatgaaagtatcctgttctcagtgatctaacctttttaaaggtactccaatgcaaaggactttaacgcaaagtgtagatactcctttctatggaatataaccctagtcatgacaagtttctcctttgtttactccttggaataagtgaaggtgatttaactcagagaggaaggtagggaagctatttcagaaggaagatacctccctaacctgagtgatgggggttacctttcctttgcttcccactcctccacattgcctgttttgcttaaaatatgacttcatccctttttcttcttttgttgtcatgggatattggaatgtaggaaccaggatgtcctgagtggtaaacttagctccactacctgagaaggacgatgtggcatacacccaccccatggacaacaggctgctgggactcctttttggaaacatgaaatatttacacgcacacacacacacacacacgtacgtgcatgcgcacacatgcacacagaggcacgcacattaactaagggaaaatttttactttaacacttcccttggaataataagccttgtagaactaattgtggccagattttattcaaagcagaaaataacatagaggaaaattacctactgctgtaatgtgatggttttgtactccaaaatgaacatgagaatgttcattcattttttagagataggttttttattcacggtataaattttgtggaaaaaaaaaatgtcattcttccaaactggttgtgacctgtggaatttgggaataaagccacgtgtgcattttaagcattcctaccttggtgctttgggttaaatgccccccagcggtcatccaatagaacctttttcttgcctccctcaggctttgaaattacctgtttactggtgtctctccatatacctacacatttcttgagggcagggactggactttcttcattttgaatcatcagtgaagagtttcaaaaaatatgtgtgaatttgcatttgtagtagaagtgctttgaagaaaagagagtttgaaatttaggagagggttccatggcaatctttattaagttgattggtatttataatatcttccagtctgtggatcgttttaaaggtatgctaggctagcaaagctgataaagtcagagtgatctcagattgacaggtgggataaataattagacttttggtatataactctcacagagaaaatctagagtgagttgatgcacagtagaaggaaaagagctctaaaagctagatcgaaagagctttttaaaaattaggaagagcaagcaaggaggaggggaatccagaggacaggaggatgtcagagggctgtgtttcatgggggcctctaaaagtgtccatggaaagaacgctagttgcagagctcctgggggagacaggaggagaggtgcacaagccaaactaacaggccagagtgttttgtttgcaacattagttttaactttaaatacagccagtttctttggactcgcagcccagacagggagagggaatagggaactcaacgacttcttgaataaacaattgcaagaaagtcagtaaaacccaatgagaccaataatgaccccacaaggtagggcctgatcctgtgggagattatgggtcagaataaaaacagttagtattttaaacgtgtgttcagtcatctgaatgatataaactttagctattattattatttcttcactataatttgtcaagtggaattcttttgctgcctgatgaagatgatttgtgcacttgagctgaccctgtattggatagggaggaagaagaggtcatttcaaatagaaggggaaagtaaagaaaagttgcgtgaatatctgtagaagacacgtgtgaaatcttatttcttctctttattggacttttacaagacgatggcagcagcagccagggatgcaacaagagtcacattcgctttgaaggctgcccttgaggaatggccccatttttcacaactgtacagaagtcatctctaggagagctgcagcaggcaaagccaagccggctctaattaatgacccaggctaatattggtctttgacgttcttggatattaataaatgttagataagaaaagcagctgtttatctctttgcccaatacaccttcaaacattcgtacaggagatagatatcctaatgtaaacatttgcagcctcacatattgtcgggatctctgaactgtgactgttgacagcaggttgccttaagtaattgcaatgagacagaataatctagtagaagctattgtcatcctaagtaatattttcctgagaaacagttatgaaaaatgaataatagcatttagtaatgcataatgtgagagtcaagaagaatattgaagacaaaggatacaatcatcattgcttgaggaaaactaaattttatatagctgtcctttgttgttatgttaatcaaattataaaataagcgatagtaggagaatagcattgctgtgttataaaattagttttagaattagattagttctgtgacatgagatggatcacagtgagattatacctcatgagtactcaactcttgtaaacactacaatgacatcgttaaatattccatgcttaaaacgcacagcacgttaactcctttatttcaggggttcgcttttatagttagagaaggttttttgtttctttttttttttttaacttttagactatacgcatacaatatattacaggtgcctgtgactcgctctaaaaatgttggaagctgaactgcatcatattcttgagggagaacttaatgtcaagaatttaaatttgcaacacccattaatgtgtatttagagcatttcaacaaagaaatacatttagtgacaaaagttttaaagtattacagaagagtcagaactgaaagataactcatggaattttaatgtaccattttaccaaatgtcctaaaaaatgatgagtactttcacaagtaaaaaagtacctaaaatttattattgttaagaaacattttatgtcaatctatgttaaaaccacaagtttgtaaatttctgaggaaaattgcattaagagtgtatggatattttaggataatgattaaaataatccaagagaaaataacataaatacagatatttaatgatatccaattcggcatagatggatgtggctctaattcagtgtggcaggaactccagaaagctaattttaacaaaagaatgtaatctgaacaatattaaacatgtaggtcactgtatttagagataatcactataattttaaacctattagtaaaggttgtaatgcaagtgtgttgtgctagagttctccaggaattactctcacttctctactgaaaaatattaaaactaccttcaaagataaagctgattacagcataacaaagcaactcactaccacctctacttcataataaatacaccccacattgttgtgttagacatgagtttcacacaatttattgattagttgaacttttaaaaagtctattatgttgacttcatgtctaacccttttataagtgagtggaaataagttcttttatttcttcccctattccctcactctcatcactgcggagctccgttgtttttattatcttattcattcctggtcttagttctcttagctttgttctgttttacgtgtaaacccatttctatgtggaagttcttctatgcagagagagcaggagtatattctttatgcttgggacaataaacatttatagactgaacattatacaccaggaattgtgctaattgctagatttacattgctggaggagacatgatagtcctctcagagcctacggtggaatacaaacagagcagcacagtgattttctgagtgtaacagagcatgcagtcaatgctctgggtgtcttaagagctttgcttagcttatccttggtggtagtagtggaggtgagtcaaagaagtcttcctggaggaggtgacctgtgacctaaaatgtgaacagcagataggacgaagaagggggaaggatggaaggtggtcatttcaagaagtaggaagcagcatgctcaaattgtataaccctcaactgtatagtatttgtggaaaaattataagcaatttatgtgactatcatatacagttctaggaggtggtgtgtgatgaggtaggaggagccatgtcatggaaattgttgtccttgtaggatattcacagcagcttgggctttaccctagaagatggggagacagttggagagttttaagtaggtaactggcatggctgactttacatgcatcattctgccagcaggacacagaaaggacttagaatagttatatgctagggtacagcctctagccagaggatgtcgacaaaggacctggactcaaatcatggtccacaattctgccaggttctagccctactgaattcagaaggtggtgcaaagattcttttttttttttttttttttttttttttttttttttgagacggagtttcgctctgtcgggcctgcggactgcaatggcgcaatctcggctcactgcaagctccgcttcccgggttcacgccattctcctgcctcagcctcctgagtagctgcgactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtgcaaagattcttacaattcataaagagaaacaaatccagctatggagaagaacttactttttagtatagaaactttcagatatttatggacatttttcatacatactaaatcttgaagcagagagcgacaaagacatacatttgtgattcaccagcatatacatggtcgtgaaaattgtgaaagtggatggagttttttaggcttggtttatattaatataatgggaaagtgatggtccaggacacctaggaagtttgggagttcaataacaagggaagaacttccagagagagctggaaatggaatctgtaaattttaaagcagctgggaagcagggatgaaatataatgtagtgggtgggagcatgacaaagctcagtaggcctggtgtggtggctctcgcctgtcatcccaccactttgggaggctgaggcggtcagatcgcttgagccaggagttggaaatcagcctgagcaacatggtgaaaccccatctctacacaaaataagaaaaaacaaacaaacaaaaaaattagcagggtgtgatggtacatgcctgtagtcccagctacttgggaggctgaggtgggagtatctcctgagccctgagaggtcaaggctgcagtgagctgagatagtgccactgcactgaagcctgggcaacagagtgagactatttcaaaaaaacagagagacagagagagagagggagagagagaggcaaagagagagagagagagagagagagcgcactcaggagagaagagaaatctcaggagagaagtaagtttcaagaattttgctgatcaaggaaggaggaagactaggaatggaggaaacatgaaattcagcagactaccttttgaaaatttttgttttatattatttgtatgcttttccttcgtattttttaggataaaaataattgaaagatgtgtatgggctacaggcaaagagctagttgagactaagattggaaatatgggagaaaacgggataattaaagaatcagggtcctgggtgaatgtcaggtaactggatctttctgtataaagaagtttgggctaatatctagaactacattatggtaaattttcacggaaattaactcagagggatcatttccagagtaattttaagcctatagagatattttaagaaatcaggccatattttagggtctctcaagaaaattcacagaccaggtcataaaatacaataaacgaaatgttttctaaccacacataaagatccttatacttgcttataaaaagagatataggaatttatactacactgcaataccatttatcaccttgagattggcaaaatccaaaagtagtgaatactgtcatgggaattgctgttggaaatgcaaaatgctacacctctttatggagaggaatttgacagtgtctagtaaaattatatatacttttaccccttgacccagcaatcacacttttagacacctatttcacaaacctattggtaaaaatatgaaaaaaaaaagcacacctaaggctgttcactgtacgtctatttgtaatagtgaaagactggaaacagttcaaattttctttaatagtattgttgcacatctatacaaatgcaatacttcacagctataaaaatgattcagaaaggtaactatactaaattttcatcattatatatgtatacacacatatgtacaaatatacaggtgctccttgatttatgatggaattgttataaatagcactcgaacataaatttaattttctcagcaaggcagttttacttctatagaagggtgtgacttgcagatggaacaatggcaagagcacccctgaacaagggaggggaaggcgttcttattctactgctgtgtcattcccctgttgtctagggttggaccacacagtctaagctaatgccgattggctatttttaaagagatcaggggtataagccggagtggcggggtgagtagtttggcaggaaggatggttacagaacaggtgactcaggatgagccgggacagagcaggcgacaaggggtgactcaggtcaaagcaggtgaccaggggaacagatgtgaactactgattggaactgacgggaaagttatttactgaaactagagccaaggggtgaagagaaccaggaagttaaactttaaaatggagcatcaaagaataacagagctgaacatactgacatactgattctttgaagagaaacttggggttcactatatttaacaatcccccatcttgaattttttcagttctttctcttcagacttccttaacatgacttggcttagttgttctgcttgattctctaaaagaaaaaacttctctgaataaggtggaggagaatttagaattaataatgtggaggacgttttagtaagtgctgcctctatgagtctgcgccccagcccacagatgcatgctatgacacaacacccgagaagaacgagtacaccttctacgctgcgagagaagtaagcatcgaggctatgattcctttccatttactgtaccatttttctagccaccctgtgaaggaggcatttactcctcctgagtttttggctaactccttggacagagcagttagaccttgcaatgcctttgttatacttccatcaggggtggtattgtttggatgaaggtgcaacattgagttttcatcatgaggtaaactcctccgctttctgctaatatcatgtctaaggctcttctattttcccaagccctctggctggtagcccctaattgctcagctattcctctaacagcatctctactgtagttaataaaccactgttggtagtaataaatgtaatttattcaaactatgttcttattaattgtcacccaccaaaatattgacttaaatcctgcagctatttgatcttgggttttaaattcatctggtactcctcgtggaactccaatagcatctatgtaaacatgggggtcaaaggacccatgtgaggcacttcttctacaatttttttttaatcatgttgacggaatcctagggtgaaaggcatgaccagttgaactagagcacaagtgctgctctaattactcggcagagtacccagcaagagtcccccgcaataccaccacacatctgctaggggatgaacaagggcagactggtgggtaagctcttggaagggcttggtttcactgcaccctgttaagtctacaaggaatactcgcttttcccccggcggtgaaaggcacctgttgaagttaacatcaggggctggaggccagatggccctcgggggctgacccacagggttcaacctcagggaacagcagtgaaagagtctcgcatgactcatcgccccaggctgtggggttttggaagagagctaccatacagctcatgcccggtccgtgagagaaccgcccaagtggaaaggggataatctgggtctctggcctgcctgtcgcacataacagtcgcttttgtttagcgtgcgaacagaatatttaatccattccagccaagcatttgtgtcctgatatcctgtttcaattgctatagtttgtttcaaatttttaacctctacagaaactactttggttttatcattgggtttataacaagagaaggtttggttagcggagaactcaggagaggaagaaggaggtgcaggaggtgaggaggcaatgaagcacatttcaaaggatcctatggggtccttccctgagacttctgctcctatactatagaaatggcttaacgaaggggaagaactctggggagcagagatggtaatctgtactgggttacagtgatttatctgaccacggggagggctaactcctttagtaaaatgaatatatgtggttttaagaaactgcaagtactagctggggcggtccatccttgctcttcggtgttttacagagcattggaccaacttcggcagagaagctctgctctaggaggacaagatttccagtttacactggaattttcgtcaaacacttctcaaactaacttgtcccagttcacagatttttagtctgaggaaagctaggaaggataaagtacttttctgaggtggagagttgcctctcacctggcaaatctccacagggtataacgaggcaaggatcaaatgtaatagtttgaggcagaattgacgtggttacgttaataagtaggtgaccagcaatagagtgaggaaagaagaaggagtaatagaatagatgaaagagagttacatttttcttagctttagtttggtagggttttcccctaggactatggcccatgacttgggagggggcggcgctttcttgacttgagtattatgggtccatcctttttctggtgtccggactgtggtttcggtagttaggagcactaggtaagatccttcccaggccggttcgagcttttccttctctccagctttggatgaggacgtggtccccaggctggtgttgatgtactggaaactccaggggtggcacctgtgctaaaagacctttagctctgagggaagagaaagtggaagataaaccaagtatataacttctgagaaactgatcttttgtttcaaatgtcgggagatcagtagtagaatgtagataaggcagtccataaagcatctcataataggataggcctatgtctttttggggaacagttcagactctcaacagggtaataggcctttctactttccctgatgaaggtgggtgccagggattatgatattcccatattatatccagtacctgggctaatttcttaatggcacgtgcagtgaaatgagtcctgttatctgaagcaatgttttctattaatctaaacttgggtataatattttcaagcaatgtcttgactgcattattagcagttgtacttggaaagaaaatgtcttctacccaatgagtaaggtggtctactattactaataaatactttagacgaccaattggaggcatctctgtgtaatcaatctaggtactttggaatggccttaagcctggactccttcccccaaggggtaatcttttactaagcaattgtctgtaaccatttggccagggtataaatctctatgcacccataaactctgaggactgcatcacacatggcttggggcccccagtgggtcccttgatgcagttggaacaagatttacctcataaggggtttggataacatttctctcagtctagcaatatccagtttccttctgaattctctttagtacctatttttattagtttttagaccaaagaaaaccaaacagcattttatatttgacagtgcttcctgtatgatttttataccagataagctaaatttcacctttatattagtgggctattaatgttaaactcaattttaataaaaccttgtagacatatttatccaattttaatgtctgaccataacataagatttttatagactctttttaaccctttataatttttgttaaagagcaggttagtgctttaagaaaaacccattgtgctttgattttaataaaaaattaaaataaattttaatttattttaattaattaaataaattaaatccttttacacggaatttcctttacaattaacgtttcaaaacttgcttaaactttaaaacaaaaaaaaaatttttaaccttttaatgtaggtatgaatccacattcttatgcctccttacaatccttttaccaaaagtatattttactttccttacacaccttgcaaataaactgtttcttcaatagttttacattcaggaggccgaattacttttaaattatacaacatttcttgcataaattcccttttataacatgtttcacaactttcacagacaatctttgacatgccttaactttttgacttgttgtaaacatccctttttttaaacaaccagttaatttactttcggacaagaatttaccatgtaagattctttttacatgaactctcctttttttaatgtcaaagatgataacagttcttttccaaagcaagcttcctttatgtctgtggactagactgcctaagaccaccagattagaagttaggataatacatgttacagtgttaacttttagcaaactttacttttgttgaaaacctgtaagtttgggattttaattaaagaaaggcttttctgatgtccagggccatggacaatagctgttccttttggcaagtgaagattatttatacgtgggtgattaattccttgtggaacaggtcttggtctttgctattaataagccctcattcagtccaaatttttccaaatgtatggaccactcaaaaggcgtacttagaatcggtaagatggttccttcctggttctctaagtactttaaatcttggctgagtgcaaacagctcacatgtttgagcagaccaattattaggcaattttcctaactctatttctacaagagtttctctatcaattattgaatacttattgtgtctttttccctcaatcacccgggaggaaccatctataaataagtgtcatccagtcctgaagggagtttctcctaggtctggtcgggcctttgtatggtaattaattaaatctaaaaatgtgtgctctctcttacgatttggatcccctgttaggaaacctgctgggttaagtgaattatcagtggttaatgttaaatcatctttttctaacaaaatagcctcacactttaagatttttgggtcagtaagctactttttggctttctgacttaggatagttctgaccttgtgaggtgtgctcacaatgaagtttcctccaaaagttatttttctactttcttctgttagcaaagccgttgctgctaccgattgaatgcatttgggccatctgcgggttactgggttaaggagtttgttgtttttttttttgagacggagcttcgctcttgttgcccgagctagagtgcaatggcgtgatctcggctcaccgcagcctccgcctcccaggttcaagcaattctcctgcctcagcctcctgagtagctgggataacaggcatgcgccaccacgcctggctaattttgcatttccagcagagacgggatttctccgtgttaaggatttttgataggaaggctacgggttgccagtggccttcgtgcttttgggtaagtatttctaaggctacgcacttgtttacactgacaaaaagatggaatggctgcttgaggggaaagctaggacaggggcagttactaatagatgtttcaacctttccatctgttggatttctggtaatggccaaacgaaggggtttggcccgtcttgcgtgagctttttgtataaaggctttgtttttagggcataagagtctatccatagacaactgtacctgactaattctaaaattttttaagttcacagtgttctgtgaacatttgtggaatctacacggcagaggactagaatggacatttatgagtgatgtttaacataacaatgccacctgttggatacagtaggagattactctgtgtttcatattcttagacactgatctcagcagacacagaatctcgggtcccctttggaaaacagcattttatgaagagcctttgatgcattatgcacaggagagaaatcgtggcggtgaatttcctagtgttgggttttgcctgtcagataaacttaagctgggacagtgtcttttgcagatttggggatatattttggacattcagtgtgcgctcatgatgatcactgactggacaaacttatgctgatgagtcagtattgttattagaagatgagaggggctctgtaatttgaaatctattttctactcctgagacattgaaagggattccaatttggattcaatgtgggtggctttcaagatagttcttttaagatcatgtgatctttgcccttctcacagtttagtgttgtctatttttaaagggtgttaggagtaaatgttgtttatgtttaagcatgataatataaccatacctcaccgccacccctaaaacccgtagagacgaatacatgatagggattgcaactgtggaaggtaaacaaataagcaattttgctcatttgttttttaaaagtgtgactatttgtcttgatagtaataccttgagcttgtgcttcaaaaatctgtccagctattctcttctgcagacatattcacactctcaagcctgcttctgttaatgtgtttatgtgattgttctaacacggtgaatactgcttttgactatatgtacccagaaattattattacatttttttgtaatttacagaaattattattactttttttgtaatttagataacgaaccaaacttgtggaccttttttgttcatttagaagtggtaaaggttgttccgtgccttgacagaattcttaacagctgcctctgccttggttttgctttatgcgcttccttccctcaatggccatggcattgtatttcgggacactcttccctccacaaagcaacagggcaattcttcagtggatattagaatttttctcttctttttctgcaaaccctgatgcacccatacacagcatatcttttgttttattacttccagtttggtgaaaaactggatttgtcatgacaaccaagtatttagtggaacagaagcagagataaagaacacatcttgaaaggaatacacaggatcaatatttcatgtccatctgaagtgttttcagtgttgttgaggaaaaagtatacatctcattgaagtgtcctttttttcccagggaccagatgttcattttatttatcaattgtggacaatccgtcaagcccagcaatatttttccagagatttccccctgtggttttctaatttatttgatatttaggaaaagaagaattgcagctgctgcagaagaattagagttcaacttacgtgtatgtgatcattggagcatgttcctccgtcagacattaaacgtttaacaggacacagtaacttatgcttcgtttgaattttgcatctgcctgcttctcctaactgggtgaagaatgctgacaatgacctactggattagttattcctctcctctattttatgaaatatttcatattttatatttcaaaatatgaaagcatattttaaaattactataagactatatttattttagatactctccacataattagtattgcagagcttcctgcttcaaaatgtatttgtaatttttttctaattgcactgacccataatagctaagattgaacctacatttaaaaaatttaatttcccttcatgttagtgggtaactataaccataaaagagactctttttttaaaagattggacttttacatttattaccactgtaagtgcaatgagataaggcctctgaccatgttcttttggagattgttaaggcattcatgaatcctttggagctgtcagcctgcacttctcactttgtcagaacatatggatgtgtgggtgtggtatgcaagctaactgtcctgaagaagcttgtcaaagaaatgtttggaggaaaaaacaccataacactgagcataagtttgaatatagccatatactagaataaaatatggatatcaggaaagagcttcctatcagagattgctaacattggaacttaaattgcatcttgaaaatggattaataaggtttagcccagtagtggtaagttggtggacattactagtgggtaaacattacatgggcaaaagttagtaatggaatattgaggaaaggagtctgggctgaggaaacgaaggagtaggcaaggccgggaggggtggctcacgcctataatcccagcactttgggaggccgaggagggcggatcatgaggtcaggagatcgagaccagcctggccaatatggtgaaaccccatctctactaaaaatacaaaaattagccgggcgtggtggtgcacacctgtagtcccagctactcaggaggctgaggcaggagaatcgcctgaacctgggaggcggaggttgcagtgagccgagatcatgccactgcactccagcctgggtgacagaatgagactccatctcaaaaaaaaaaaaaaatagaagtaggcaaagaggagaatggaataactggagttgggaatatggactcataaacttacctttaggaggagttactaggagagtttcacatcagcagtggtctaatcaaaaaagccaattaactccagccatttttagtcactgtaatttggctccaaattcaagttttagggtaagatatcttattggctgtatcttcaagttctttaagcattgacatcagattttctgtaacgcctttagagcctgctataaaccctaatagatgactttatctgggtagctagaatttgagatacctgtgaatcttggctgtaaaatttgactcaatttgcatcccatttggatgaagcaacaggatattagggttttgaagtatgcttatgaaaataaatatgctatgacgtttgtaattggtatgattcagaatttaattagataaactacctagcatttctctgtattttcagaatcttattaccaacttttgtagtactccccaaagagcaatttcagtaatttgtagtgtatctctggacgtgataaatgctattatatcactgtgatttgtaatagcagtgcttttcactgtgaaagatttactgagattttctaattgacttagagcattgcctctcaaactctttctctatttcttattcactgtactttctcatcacaacttagtaatcatattaatcttgctttcttggaaatgattcatatatttgcatgaagactaattaaaatacatatgcctgtcctaaatgattaggctaagacttaaatgagcaactctcagcttaaaatcctccagtgattccccagctcgctcagagtagaagccaagcctcttataataggtcgtaacaccctggtacttttctggattcatctcaaacaccctcttactaataccactcagctttatggcaccacttttggttgtggtgaaggcaccaacaaaaatgtttattgtctgaatttggcatgtgtgtgtgtagtagtgtatgtactcacatatctgaaaaatatttaccctttaatataactttctgtcactctgtatatacacctccagattcctccagttcagacatgcatttgcctttgctgtttcactggtctggaattatcttctctcagatttcttcatgtgttactccttcagcttcttaaacacgttgatcaaattacttccagtgattctttccctagagggatttacttaaaattgcatcactttttacttatttattctcttcattgtttgtgtcttctctctgctcatccccccagccccacccagacttaagatcagtgaagaagattttttttcttgttcctttacattactaaatctccagtgcctatgtcaaactccagcatggggttaataaatgtatgtagaatgaaggaaagcctcttccaaatgagtgcttaccatcattattgcctctcaagaagtagatcttaatatgaaaaaggatgggaaagttctccttaccttttcttctaattctttgccatgcttgaaacattaaatggaaccaaatttctagatttatttctatttacatctccaaacatttgcaatccttataaaaaacatggtagaggctaatcatgataatgtagataataatagtagtagtaataataatagctaacatttattgaagacctattaaagttcagatataacttttattatatcattaacaaatgttattaatttaataaaacctgtaattaaatttttaacaaacttcaaattcttgatgagcaactgagttgataatcctatttgcccattttgaatatgataaaaaacagccacacttacagtaactttatttatttgtgtgcatattatgtatgcattttttctgcttgggatctgttgtgtatttgtatggggattttagtatatgtagtgtagagactatcactgtcaggtaaattctgttatttcttttggagcctattggcttttaagcactcggcatgaaatatatatttcaaataactattaagttgttatcatctgacttttttaaaactttctacattaagggacttttcattaccttatttgaactactagttcttggtttgaatgtaacaaattcctgggaggcccgttttgaccgcaaagaacaatgtagcactatcttttttaaaataacatacctacttaccaaaagaattgggagaagaaatcttgattcatttaggattagactaaaaagttacattactttttcttttattcattatctttttgtttatagcatgtatcaagactgaagagatgatgattttaaaaagataggcattgtattatgatttgctttttcttcactgtttttataggatgattaaaaatatctggatttcataaggcataattgacaggttgcagatctgagttggagcacatatcaaataatatataaaaccttctgcttgatacttttgagatcaaacattgtcataacacccacagtgttttaaaataggccagaggacagcctcctggatagctgacctttaaccaacaggaagtatataaaatatctgcagagtagaatgactatattccaaacttagattagacagaaatgacaccagctctgggttccatcactgtttctgtgcatccgttgttgcatctgagaagcagagtgctttttgttcccccacacttcatctagtttgaagcaagaaaatttaacagtgcaacaaaacgaactgccttttccagctgaactctatcttctctgacagatggttcggttgggcgtcttttccatccagagcagtgctgtgtttgaagaatgaaagcattgagagagatcatttgttgtatagagcagagtttcaaataaccattactactggcaatctctgctgtaattcctggattttgagataggtgtacaaggaactctgtggtgagattaaacattcagctaatttttttttcccccaaagtcattaagtagctagcatttaattttttatatgtgcagattaaaaatgaaggttaagtaccaacaaaggaagctccgttcaggaaaactctggtatactctttggtgtctttggtggaaatgactattcattatgcggaagaataagactttataagaatagtatttccctaagcaggcacagcacttgagaaggttacagaatacctgtttactctgctaacctaattctctgtcgatttctcttgtcaatgccttttgatattttgacacagaatgttctacctaggaccactctgctgaatataggtcaggctctggactctttctgaacctattctcataaatcgcaattttattactgtttatacttgtctacttgagtcattccacacaatgggaacttatttttaatactaatttaaaccgaggtgctactgagtatcttgcttaacatatttgcagttcctgaagacttcagagttttatcccaaagaaataatgctcatagagaggaagcagatatactagttattccttggaagaggaagaaaacaggaaatggatatttggaaacaagagagacttccatgttcctcaattcatagcaattatccagtcctactttggatcatcctcctaatcctattaagaaaataaatgagactccaggcattacaaaatctgaaaggtttttagaaaaacaagctactctgaaagcgtatctttggtcaacacagccaaacacaactcacagttttaaaaacacagaaccggccgggtgcagtggctcatgcctgtaatcctagcactttgggaggctgaagcgggctgatcacctgaggtcaggagttcgagaccagcctggacaacatggtgaaaccccatctgtactaaaaatacaaaaattagccgaatgtggtggtgcatgcctgtaatcccagctacctgagaggctgaagcaggagaattgctggaacccgggtggcagaggctgcagtgagttgagatcataccactgccctcaagcctgggctacagagtgagactctgtctcaaaataaaataaagtaaaataaataaaaacatagaaccatttggtgattcctttagagacaggtcggatttttcacatcacttcgcagtcgatgaagccttaaactaggacctactaattgtgtctagacataaacagaagaggaaatgagtccaacaagaggaaacaagaatgattctttgtcaagtacactatttcttttcaagagctcatgttatcctcaagttatatggaaatcctttcttgaaaaatgactccacctcctgctctgtatgtgctcccagcccctccttccacagtggagcagtaagagagtgaaggctttatgtgtcctcaagagcaatgattttgcaaattcagaattgctacttcctcaggaaaacttgaagttaaaaaaaaaaatccttatttgaagaaggaaaacattagggcattatcgggtgagaacgtctctcatttcctctcacacattagggtctttctttgaaaagtagtgtttttatgtcttaggatgagggtactgcatgattcagggttctcaattttgtgttaaattaatatctgtgcattcttaagatgctatttatcaaggtggttttacatttgatcagaactcagccacagatgcattttcattatttatttttatagagatgtagtcttgctgtgttttccatggtggtcttgaaatcctggcctcaagggatcctcctgcctcagcctcctaaagtgctagaattacagacatgagcacccatgcctagcctacattatataattaattaaaactttaaagcaataaaggctactgaattttaagttaagcaattttctatgacctagaaacataaagtaaaatcactctagtttgtcacaaaatgaaaaatatatgctaattaagaatcagaaaatcatggctttatggaattgaacatattttcaatttgctgattaaactccctgggaattttaaagtcatctaattcagcttcttattgagaattttctcttttaattggacagctttggtctaaatacttccagtggacctacttgcctctacttttcgaggaaagtctatatcagagacacttgtattattttaatgtgtttcataattttgagaatacaaaattggattctgcatagctttacttgcttttcatatttctctatgtaatggggatatttttgaattctagagcagcactgtccaatagcactttctgtgatgagtaaatgttttatttctgtttaatatggacatgtggctaatgagcactggaagtatggctagtgtgactgaattactgaattttggatttcatcaatttttaactaaattaagttgaagtagccacacaagtcttccatatcggcatagttttagaaatattgttttcatcaaggacagagaaagaagaaaatacctttctcttgtttgactgcctaatgggcaaaattccttttacaaacgttgagaaacaaacaaacaaacaaaaaacaacaacaacaaaaaatcttttggagttaatgcttattttgcatagaaataaaggcataaaggaaatttcaatatatggccaactcaagtttagaaaacagtcagctctctatggtaactaaccaaggaagagatgaataaggaaggtgtagaaggtggggaataagacctgcttaccagcttaaggacaactgaaaaatgacaagaattcaactgccgtgtccaagacaatgttttctgcaagaatgagtggattttaagtacaaggaagagtgttggcttgagtctggtcttactatgtttttccctctccaaccttattttttcccaggttgttgacagtgtgtaatttcaatagatgctcggcacttttctcacatctccactggagatgagctttatacaagtgaaagtgctactgagatgggaagatgttagataatggcatacgtgcttcttttttaattttttctatgatttgcctccattccttaggtcagcatgaacagattggagagggagatgctgagtgtgtcatactgaactgagctaaattgatcagaactaagggtgatatgctcccaaactactaccctatcctatttacagcttcatctaactagtgaagtaatttttctacctcaggaaaattaaaaagatccacacatacacccccacacccagacatacacatagacacatgcacacaaatccatgaagttggcactttggctttgacctctcatgatcttcttgacctctctatgatctgcctcagcctcattttccctgtccaaacacaaaatattttatactatccaatatattttattatggattttttcttgttaaatttccttttctcctatctattcaatcaaaattctttccctccatggagaggtttccctaacaatagacttctacctaattttcatattaaagtaacttatacttagttgtgaggaagttctctaggttaagaataaatatcatagagaaactttattgtcaaatgaatacctaaatgacaaatttctgtggcgatgggcgagtttaagcagaagagactccccctcacgttctatgaattttcttcagttatcctgatttgacttgattttaggctacttgtgaagaaatagaaattttactaattagtgaaatgtcttctacagttaaaaatccattaaaccttttctgtctatttctgatgtgcagttctgcaaaaactgggccctcttaaaaggctaagtgaccgcttttagtttaggtgagatataaaaacacaagtagcaaagaaagtaatttacctttgtctagagaatttattctctaaatatgcacaaagaataggccatatgtcagactttgtccttagaattcacgggaagaaggaaaaagactaagcctctagcctcttgctattgacaagagcaatagatactacatggattatatagaccttgcatgcagttgtgatgaattcgttgatagtaacagaaaaaaaaatagccttttgacaatgccagcactttacaaaacattttagtcacaactctaatagcaaaacaaccactaaagcagatgttaccaccctcattttagaaatgggaatctgaggctcagggaaatggcctctgtggatgaaaactttaggttttgttcctggcagtagtaacaaaaaaccaaactcactaaacaggtcataaaagtaaggaagcaactcagtttcatctgtctgcctgttctgtcagatagtgacagctcctcccgtggggagcagtgaatacatgagtgagaagactttttaataacagccattctgactggtgtgaaatgacattcattttggtattgatttgcatttcgctgattagtgatgttaagtattttttcatgtttctttggccacttttatgtattctgttgagaaatgtctgttcatgtcctttgcccattttttaatggggttgccttttgctttttgatttgtttaagtatcttatacattccagatattagatctttgttggctgcatggctagtgagtattttctcctattctgtaacttgtctgtttactttgtatatagtttcttttgctgtgcagaggctgtttagtttaattaggtcctacttgtcaatttttatttttgttgcagttgaatttggggacttagtcatagattctttgccaaggccaatgtccagaagggtatttcctagattttcttctataatttttgtagttttaggtcttacatttaagtctttaattcatcttgggttaacttttgtatatggtaataggtaagaatttaattttattcttctgcatatggttagccagttatctcaggatcatttattgagaagggaattttttctttattacttatttctgtagactttgtcaaagatcagatggttttaggtgtgcggtgcggcttcagttggtgggaatgtaaattagttcagccacagtggaaagcagtttggaggttcctcagagaactaaaaatagaactacaatttgacccagcaatgccattactttgtatatacccaaaggaaaataatttgctctaccaaaaagacacgtgcatatgtatattcatcacagcattattcataattccaaagacatggaattaacctcggtgcccatcagtggtggattggataaaggaaatgtgacacatatacaccatagaatattatgcggccgtaaaaaagaatgaaatcatgttctttgcagtaacgtggatgcagttggaggccattattgtcagcaatttaacatggaaacagaaaatcaaatactgcgtgttctcacttgtaagagggagataaacattgcatacacagacataaagatgggaacagtagacactgggagctggaagagggggaagcagggagtggtacaaggattgaaaaactgcctttgaggtcctgtgctcactacctgggtgatgggttcaattgtatcccaacttcaccatcacacaatctatccttgtaactacctgcatatgtaccccttgaatctaaattaaaagttgaaactaaaaatgagtaagaatctgaaaagaggaggagcaacttctcacttcagggaagctttcttatgggagtatgttttatacacacatatacatggtatgtatatatgaatctgttttatgaacatacacctatttccttacggactatgaggacaagaaaatggtgtttccctcgtcaggtgactgggctgctacttggatttatgtttggtaaatatgttagtgtgagataatgtaccatacgcctccagaaaccaattttttaaacaatctatagcaccataaattagcattttctagtgtgactttcaaatattaattactattctctgaaaaaaagtttcatgaagagagttcagttcacagagtccaggtacatgtgagaaactgccgagtaggttccttcctcaaaactctgagaagcactgcaatagaaaaaacatttgattttgcttaaagcaattttccccatatttgacaacaaaaccatgtctatttgctttttttctcttccaaagtcaagctattgacatatttgttctacagaagacatctgagaagatttttattaaaccaaataaatgagtaacatggaaaatttgagcatcatagtgggattagagaaacatttttggcaggggatgggttgtgggcaaccattttattattccatttagcttggtttactcctctatttattgatgtctggtactgtaagtgtataattatttagtgttcagtaaatgctaagccatattaaatggtaatggtaagattaagcatgtgcatgctatttgtccaatctagatacaggctaggctcaaagtatgatgtaacttcagccatgctgagggttctataggctttaatattcttcaaagatgttatcataagacctaatagaactagaaacagaacatgaataaaccaatatgactgtattggagatttttccgattgtcaacaagtgtttcgttgactgttccagacttttaaaagtgctgtaacttcaacatccgaatctcctttttgtgtgcataataaacattcctgctttgtgtaattttaactagaccaaacgatgcttacacttcccagataccagctgttgaagcagcaactttcaaatgattttgcagatcggcaaacacattatatcattgtgtgttttgcagctgtctcttcagttagcctggttttgctttttgcagagtaacttgtgtacagttacagaagagtatttgttttcctccaacagtcttggcaattagtgctttcctagcttcagttttactttggtgcaataggcaccctgtattgtgaaccgtttataaaccaaggtaatgacttgtgggtttttaaagagtgcttactgcaccaaaaaaaaaaaaaaaaaaaaaaaaaaaaaagctttctcctggcttgagtgattttaaaaccgtttagtcaaatgtttgagtgcctattgtgtttaaggcactctgtaagtgttttgcatccactgagcaatacatagtagaagttagttgtatcacacgtagatgggaaggttattctaaggaacaccacttttcaaacgcaagagagcatgtccctgtgatgccacagagggaaactcagtgagactagagcagagtacaaaatcagagtatcttatggtaggcgtgcaagaagtagattgcagaaagctatgctaaagagtttgtaaccgaattgaatttggaatgaatggaaatcctttggaggattcttttttttttcagggttatgcgaagatcagatttgtgttcttggtgaaagatcacacagtatagtagagagaatgaactataggcaatcacattgggtgcagggaaacgagtaagcatactattgcctagttatataacaatagattggcaaaactggatagtagagacagtgagtcctagttagttttcttaaatgaatctattagccgatgtacagatattagatagaggacgatagcattttagagctggaaaatccactaatctaagcccattgtccaagatatgaaaactaagtcttgggccaattgaataatcttgataaaagctttaaagctagatagtatcaaagctagaatcacaatccacatctctaaggatactttgctttacattatttctctttttttttttttcttttttttttttgagatggagtctccctttgtcgcccaggctagagtgcaatggcacgatcttggctcactgcaacctctgcctcctgggtttaagcgattctcctgcctcagcctcccaagtagctgggattacaggcatctgccactgcacccggctaatttatctcgctatttttattttgtattttattaactttatcattgagccttaactgcatagattaaaagagtaacttcttttaatgtaattatacattgctaaaatgaggtctcatagcagaagagaaatgtttaatggcagcttcctttacctcttgctacttgactttgagcaatgcattcctttagactcaaaatctgctttttattatttaccagtctcccttatctgcattattcagtgtgcaagtattgatttccacttatgttccagggactgtagcaggtgttgggtgaataatatgtggaaaactctatccttgaggctgttatggtgttggagaaatggacaaggttgtgggtggctctgcaaccacagtggcaggacgtcctgcccttctggggagttcaaaatggctttctggacatgaaacttgattaagagcagtgccaacatcatcgtttcaaattatctggaagtgtacatttaggagcaaatgtacaaagctataaaaatattcataattcttttttacacctaatacttgacccttgtgcttggctctgacgtgcttactctgaaactcttttgaaattggctttgtgtgtagacaacagatgagttctcagatcagaaagtaagtaaactggcatgatgttggattttggctagctctaactattaagtagtgatgacaagggtactcagctctgaagcatttattttttattttagatgacactatcttaatctcaaaaagatatcctttgacttgaacacctttcctcaggtttaagctgtaatcaagttaaaaaaaagtcaaacattctcagtttcaggaagatattactgctgtctaaaacctactaaaacatattttgcctatccaaaaggcaaaatatgtctctgaagggaacatgagcaccttggcagaaaatgaagctatttataaatcttattttctttactctttcattccttagttgtttttattggtcatatttaagatatggacatttttaatatatgtacactcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctttatctcctgagcaggcaaacaaacctctgggcaatgtggtcttgcagctcagaacagcaaagaaaaaaaaatatttaactcgataactgcaaagaagaaactgtgtttcctgggagaggaattattgccaaagtagatgcaagaaaaatcagctctggcagagacaaggaagaattacacatatgtcttaagtttatacttcctagatttctatcacaatgatagtaacaaagatgtgaaacacttcatttctataatatcttaagtaggccaggttcagtggctcacgcctgtaataccaagcactttgaggtggaggattgtttgaggctaggagttcaacactagcctgggcaacatgagtcgtcttctctttttatttttattttttatatatattatactttaaattctagggtacatgtacacaacgtacaggtttgctacgtatgtatacatgtgccatgttggtgtgctgcacccattaactcgtcatttacattaggtatatctcctaatgctatccctccctcctctcccaactccatgacaggccctggtgtgtggtgttccccatcctgtgtccaagtgttctcattgttcagttctcacctatgagtgagaacatgtggtgtttggttttctgtccttgtgatagtttgctgagaatgatggtttccagcttcatccatgtccctacaaaggacatgaactgatcattttttatgggtgcatagtattccatggtgtatatgtgccacattttctttatccagtctatcattgttggacatttgggttggttccaagtctttgctattgtgaatagtgccgcaataaacgtgtgtgcttgtgtctttatagcagcatgatttataatcctttgggtgtatacctagtaaggggatggttgggtcaaatggtatttctagttctagatccttgaggaatcgccacactgtcttccacaatggttgaactagtttaccatcccaccaacagtgtaaaagcattcctatttctccatatcccctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgtgcgtcctcttctctattaaaaaaaacttaattagagattctaatgatacagagaggaagatcaaataagtcaaaacaatactattgagaaatattcaagacatttatgttttaaggtaatttgtttattttgccaaaagcaatacataattatttgatcaagcatataaatctgcttcaatttttgtattatattttaaagtttaatatataacttgaattgtgctactccctgtgaagttttgctaaaatatttaattattattttacaaaatgtattgttttgcaaaatgcaaaatctttttctcagaaagttgagttgcttacttagtttcttttgttggtcttactgatttttttttttttggtcacatattttagactttgtgtggcccagatgataagttatcatttctcataggaaatcatatggcctaaaccaaaataaaacaaaagaataggaagtctgtgagacaaaacatggaagtcatttagcatagataatacctaggaaggcctgaataaattgccattggttacttcttaccagtcctacaagttttactgtttctgcttatgagagtagtcatctaccttccatcatcaatgcaggcatatattggatttaataacatttgctcttttgcctattgaattgtattattgctgacatcaaaactctcctaataatgtttttttttcttttctccttaaaatatcggctctgggaggacacttacccaattttctttcatttaatttggcagtaagatgctaacggtccttttttattgacagaagcaataacaattaatacaacttcagtgcatcattagttgacatgttttgtccatatattgtttcaaatctctttaagaaacaaatgatatccatatttgagttaaatacaatggtagataaactaagttagagatgtgtgcgtgtgtgtgtcagccaatactttgagtgttagaattgttttcctattcattattttttgaataaacaagtaaatgctagttaaagctatttgatgctgtgactgtttagctccttatgcaaaagacaggtcaacacccttggatttgttgagttgactgtgcattcagcattatgcaaagcaatgacccagggtgcatgtcttagctctgaccttaacctgcagttacttctcaatgaagctctgatgcctttgtcaagtacttgtactttatccatagattagctaattttcaagttgtggggttaatctttatctgtgttacctttaaactaaacacttactgttccctaaagcactttagtgctttagagaacatgctggagtgaacctccctgcctgaatctgttatgtcatgacccttcattacagactcttttgaagatgtgaggcagttttatattaagcaaagattatcggagcagcctgctttatggaaagaatcaacccaatgtacatgacatgcaccagtgtttctctttgccaaagggaacacactagtcactcacattagagatggccttaagttactatagtcaaaatactccactttggtctgtattttctttaattcagtgtaaacttttgtggagcatacatctgaaaagtccatgctggcactcagagagttactcttttagcgtatgagacagagtgatatatgttgcacgatatttttgtgtttagaatggtcatctatggaatgagattacagaaccaattttctttaatttaaaagaaaaaaagtatttaacctacttgaaacacatacaaatatgttaaaataaataaaaatagttatttatgtgtatttgcacacacaaatagataaaatattaccttgacatattttattatagcataacttgcatcagtatatgtgtacatatacatattggggcatatttgttcataaattcttaaagtagcctggttatgcatgctctgtcttaaatgagtttaatatgtcattatttcactttgagaaatgcatagttattcacattggtttatcacatatggagttgaaagagtctattttacttctctttcaggatcatacaaatagttcatttatataatcacaaaatggagatccactccatgattggccctgcccattaatattgaattttcatcacgctgttattctttacgtgagttcttaaatataaccctggtaagggctataacatgtacatttgaaaggattataaactgtgatagtagaaaattctgagagaattataggaaagtcttcactgaggactcactggagatagctggggtgtatatctccccttgccctaggaggatatcttgcatttttactttacatattttgtctcagaatgagtaaaagacataccttagagtaggatgcaacagtgttctcggatagcactaatttagaaaaaaactgggattgtaaatgcaaatgtattagagaaccattttgcaaatctcttgcttgtaagaaattccccatatttttgccccatgtcacccatccatggtgattaatactcatccttaagccttcaggttttgtcttatatcaggtattcatggaacaatgtgtgtttactttatctatctccatcctgactgatcatatactgcttaccttcgctctttttagactaaagtctttttcttttctatttatttgttcctctgacactatttttctatgcaattttgtttgagcctttctagtaggggagaataggtctacattattgtttataatttcttgtgatcattccttgattttgcttttagttgtattactgcagttaatatttatgtttactaatatgcatatgcttaatcccaaatgatactaatatgattcattacagtgtacagtatgtcaagatgactggcaggtatctgattcctaagtactataatgagaagcttaggcctatagtacttagactactgttatttcagtacctactacaatcagtagatttttaggcacatttaagagatttatacactgactgaggttcctaagtcactgtttattttatggaaatagaggcaggatttatggatagaaaaaatcagaaaaatgctttttttaacccataaaattagagtaaaataatttttataaatctttaatatttagactttggttttgtagataaattctgtgtttgagaaacaagcctttcgtgggttggggttgggaagcagtcctggggaggaaacataatatcctggcaaatgcggccagtggcctggagagtgccatgcaaattgagaactgagagcagttgtggatgtggaatgaataggggtttggtctgggtgccaagtcaatgtaaggaatgaaagctacatcccatgaagatagtttagtgacaactctggctttcagcaagttgatgaaaagctttattattctaattctgctgcaattgcaggagtcccttctgtctgggggttaagcttacccaagagtgttacttcatttccaagtctaagcattaggttctgatacatggtatgaaattgttaaactctgtggattttaaatggccttttgaaattatctgtatcaaccgaggtgatgttaagatacactgagatcattttcaattaattgtacttcagccgatgttgagagggagcaggtagggaaatattgatcaatattgccatggggtatacattttatatatgaaataattacttgtgtcactgaacatgtgtttgtctcaaagccgtatgaaattgtcagaatctgtccttttttctgacttctccctttattcaataacactcaatgatcttatatcattcttaatgtgagattgacttttgtctctaaggaatgtaaaagttagcctgattttctgtatcaactcatcacaggcactggcattcccatacctctcttccaactgagttcttgcttgcttgacagaattgtgagccccttgcttcctttgacccccaggtttcccaatccactcgaattgacaatgcctttggctctcatttttttatcctagcacatcttgcctttcctgagcttgctgtcctgttggcagctagactgctgtctttgttgttgataggacacaaattgggaaatacagggacaaaaattttaacctgctccattacccaataggtttggttttttaaatctgtatttttacttcatacaaggtaatttgcgttgtgacatacctatatggtaatgactgtttggtgggtattttcaatgttgattttccagagttgtcttagaacaaaagtgttggcattattctgtaggctggtaaatacgttgtgcttccatttatgtggtttcaaagcataacttatgatatttgtccaaatgaagaaatatctttgtttgtttttatccagcaggaacttataacttatttcaataatgaatttttaaatttatttgaccaatatgattaacatattaagttctgattttaacaccaaaaaagaaaaaataaaataggccatataattttgagcatttgtgaattttatggaaatactttaagttttaaagtttttaaataggccacatgtctagtattaaaaatagttcacatgtctattattatttaagtcaaaaattacagaagtgggcaaagatgtggagaaaagggaacatatacatcattggtgggaatatgtattaatgcaacccctattgaaaacagtatggagaaaaattacagaagtgggcaaagatgtggagaaaagggaacatatacatcattggtgggaatatgtattaatacaacccctattgaaaacagtatgcagattttttcaaataaccaaaaatagaattatcatataatccagcaatcccattactgggtatccacccccacagaactaatatgatccagcaatcctattactgggtatctacccccacagaactaatcatggtatcaaaaacacctccattcatatgtgtattgcattactattcacaatagcaaatatatggaatcgtgctaaatattgatcaaaggatgactggataaagaaaatgtggtgtatatgcataccgtggatactactcagccaaaagagaatgaaattatgtcttctgcagcaccatggagggaactggaggccattatcttaagtgagataactcagaaacagaagtcaaatatcacatgttctcacttatatgtgggcgctaaacaatgtgtacacatggacagaaagagtagagtaacagacactggagactcagaaaggtgggaggatgggaggaaagagggagaaaaaattacctaatgggtgcaacgtacactattcaggtgatggttacactaaaagcccaggcttccccactacacgatgtaacccggtaacaaaactgcgctggcacaccctgaatctataacagtgaaaaaaaatttaattaaaaaagtaggccacatgttgtttcagctgatgtttacatggaaaaatttgaatctcccaaggtctctggagagataatggaacttcaaacatttcagtgactgattttataaacgcatatgtacgtaagtgtgtatgtatatatatgtctaacttagcataatcaaaaactaagtcaaggctgggtgcagtggctcgtgcctgtaatccaagcactttgggaggccgaggcaggtggatcacctgaggccaggagttcgagagaagcctggccaacatggtgaaacctcatctctactaaaaatacaaaaatcagccaggtgtgctggcgggcacctataatcacagctactcaggaggttgaagcaggaaaaatcacttgaactcaggaggcggaagttgccgtgagcccggatcgtgccatggcactccagcctgggcaatggagtgagactctgtctcaaaaaaagaaaaggtcaaaagctaagctatatatatgtatatatacacacccatatatagacaaatatatgtgtatttggacatagacatatacgtgtatatatgtgtatacgtatacacatatatacacgtatatatgtctatgtatatttgtctaacttaacatcaaaagtatacactacaattttaaaagattaattacagcacacacgtcaaatagatatgtgttgtgtgttttagacttatccttttatctgtccgataagtgggtattcatccagaagacctaattcacatattaatttctcatcttctcacagataattgttttcaccagagttttaccaagacacttcataattaggagtaaggaataggttttgaacattttagttttgaatcctacgtctgctaattaccagctgtgtgaacttaggataattatctaatggctttaaatcttaatttcttcatctgtaaaaggattaaataatagctttctaataatactaaatgaccctttttgtgagtgctagaagacatcatacatggtaaacacctaaagagtgctcgccacataaggctcattcaatattaattctgttttcgtggatgatggttattatcaccgttgactcaagagtttggcatttttgttttaatcatttgcttcatggctttacttcctttacagatagcaataattggctatgcatcgatctttcctcagaagctagcacatgtcagaaacatagtagatatttaattaatttagggtgaataaatgaagtatgccacttctttacaaaatgccaccagtgggacttgccagatacacatatgatcttattttacttcaatttcatcatcacctgttctaaagcatctgatctcccgcacatgaaaattaagctttttggaaaatcacaccattgcggttggtactgattgctttgcccaaattattttgtcttccaaaatacactgctgattcacatcttttttttcttttgctcatgtagttattgattacttctgtctagaattgcccttgcctgacttacttgtctgattcacttactttttcaaaactcaactccagtattgccttatctcagaccccagtctaggcttagatgctcccacgtcatgctctgcttcacctacttgtcatatgttatgtgacctttcctgtcattaactgattttgtctcttactcatgagattgtattcttttcaaggatgagcatggtttcagtgtctcaattatgaatgttttgccagagagttcttagttccttactaggattcagtaaacatgtgttaagctgaactgaatattgtatatagactgtacattctcaatacagtttcttgacttatattcaaaaggacaatttttatttttgcaatggcctacataaaatgcttctttaatccccttgtaactttgctgtaaaaattgaactcaagagataagtagttttgaggttttgggaaaggaaagaaacaacgatttgattcttcttgaagggtgatctcttgttacatatttttcctatgattttaatgagtgtattgcaaaaaagttctgccggatccttatattttctagaaaatctttatttccttactcctacttctgtgttggtttccttaaaacatgacatttgaataaaatttatgccttaggaaaaatgtatttcttttaagctgtaaggtttccaacatcgtactgacatagattcaaaggagaggttccatgtcaaattttgtacttcaacaagatcctgttccattccagttcattgcatcaggctatagctttcatttaaaattttttctttgagaatgctgtgagtgaaatgtgtggctctctttccataccaggaaaatcctctatagagtagtgtatactggaaagacttataataagatatactactgatttcccatgtctaacatttggttctctgatgtttatgggctctactaatcagccttgtggtaattggttttctgaccataatttgaacagaaaatattactgaattaattgtttttaattgaaggaaagtcaatgtagtttttataatacatttttactaagagggaccaatatcatatgttcccattggaattagactcaattaacctattagtgttagatgcataaatacccatcctcatacccatcacactgagtacttattacaccctacaacttttgtttagagatagcatgcattatcttatttatcaaagtatctgaagtaactatggttatccttattttataaataataaacagaggcacagaaagttcagagttacatttgaatgaaataacatgttaaaaaagtgaaaataggttttaatttttcatcccaagatggtaaacacatgctcataacataggtctgcattgacctctctatacctggaggctgaggttgagcaatttatatttctagaccaaaattctcgaaaatgaacaaaattatattgcatttatttccctgctattcattacataataggaacacacttaatttttgtacatgaatcatgagcatggttcaagatttccagctctgactctaaatacttttccataatcatcctacttctgttccgtaagtgtatacacacacacaaacacacatatacaaatacatatgtatacacctccactcttactactgttctttctttgtccgtggtgctgaaagcaggaagctgttccataaagaataatgacagaaattataacaataaaaggtgctgtacttatcaaccatcaaaatgatgttaatcatatattgtgcataacatagagatatttgtatttcttggtatattaccctaaattctcaatataaagatcaaaagaacttaataattaggagaataaaataatgttaaatattgttagtcacactttgagaaaccaaaggttaaaagactagccaacatctcacagagagctttgaattgattgcagctgactgcaaatatgctgactaattatcatgccctttaatagtactatcttgcctggcttttatgttagcctagggaaaattgtcatggaaaaatgtgaatggctaaatattttattcaaatttatcacctgtcatcaacaactagaaatgtatgagccagttattcacccaactacatgctgtggtaggatgatggcagtgattataacaaaaactactaccatttactgaacacttactgtgatctttataagggtcagctaacttaatctttacttcaacctcataaaaaataaaattcttattttggagttacagaaccttttacatggggagatttagttgcctgttttccttggtattggagcagagttactgttccaaaccagattatctacaccaaagtctatgctcttaatcattattctgtatcacctgcttcattttatacactcattgttggtagctatcaaaattgtaggtattgtattgccatgactgaagtctgtctttatgagtcagtgtgaaacagtgatacaaaaaatagtatatttccaattagttacctcgtgtagatcttccgtgtgaccttacgaaagataccttgagtttaatactatcctaagaaaaataaattcagggtcagcatggtgtctcacacctgtaatcccagtggtttgggaggctgaggtgggaggattacttgaggccaggagtttgagaccagcctgggcaacagagtgagacccccatctctataaaaataaaaatttaaaaaaggaaaataaattcagaaaaaattgtaccacaaagtcatttgtttgcagacaattatgtattgtgtagatataaccagtctttgacagacatgtcacttacactttggaaattattagacttgcctaaacttgtagttcatttagttgatattgctgaaaacaaaacaaatcactactgtgcctttgatgattcttgagaagttcaaaagggaaatacaacaataatttgctactgctgtgccatgcactgcactacatagctcacagaatttacttttaattatcatataccttttgctctctatttcatatgtatacatatatattcatatatcatatttatttttatattcatatataatatttatatgtaactaaaatattatataatcagtggcgaagccaaaatggtaatcagtgtattttgattataaaacattaaaaatattaactatatcagaagttacaaagtgttcaattcagtacaaatgcaatatttgttgcatttatatttccactttttttttgcccagagtgtgtgttttgtagatgttgcagttgttagagtttgtccatagtatttttgaattaaagtacgtcacaaagaaattaagatttttttctcttgaaatattagccatctggctgtgttaggctcatattcatgcatagatgtattgactaaatctaggtgtactttaaatgagaatgttctctttagggtagtgtagtccccacctggctcacttcactcatttgtgttagcatatgttccctgtaggaattcaggtttgttgcttttgcgttatactcaaatgcactaaagcagggttcggcaaaccatggctcatgcggaacagcctatttttgaatataagttaaggatggtttctgcaccattacaaggtaagagaaaagagagttaataataaaaggggatgtgacagtaactatacatggtccgcaaagcctaaaatatttactatctggccctatatagatggctgacctcttctttagagtattttatgggacttgtttattctacactgcctctgactctttgaaaaagattggtagcattattcaatacaatcatggacactagaagagattttttcatggcaattagcctggccatcttgggcaaaattagagcctttgaggctttcatgtttgtttctgtttttttttttttttttttttttttctatgagctaagagaaaaccatggtctataagatatttctggaagcaaaactaataaccccacatggacagctgatttctgtgttacttctgcttttaaagccagattgggcatcaaaggattgcctgaactgttcatttggagctatttgtttgaagctgattagtgaaaatgctaagtgtgagtaagcaatgttacttaaactctaggatttggagagttttttcaccagaggaatctgatttagctgattggaagggtacactgatagatttcttgttagtaggaatttaggaacacaggggagagcaggtttagcaacacaggcatgctgattatgaagcgtggtaccacttacgggggaagaactctaatatctttagagtaaatgagtaaagagggcctggagatgaatttgataatgtatacctcacccaaaggtactaaaatagggagaaacatagcaagtagcattgtgctcacccaaccagaggcatctctagctcaatcagttcagccatgacttctcattggtaatttgatttgaatcataattgatatgatttggccatgtccccacccacatttcatcttgaattctcacatgttgggaggtaattgaatcatggggcaggtcttctcatgctgctttcctgataatacataagtctcatgagatccattggttttaaaaagaggagtttccctgcacaagccctcttctcttgtctgctgccatgtgagacatgaccttcaccttctaccatgattgtgaggcttccccagccacatgaaagtgtaagtccaacaaacctctttcttttgcaaattgcccagtctgggatatatccttatcagcagcatgaaaatggacaaatacagtaatctttgactattagagtagaagacattcaaaagcattttagtgcatcttcatctcatgaacagcattaaaaaaaagcaaataaaatggtcataaaatttaattaatttgcccaaatttgtcctaaagagtcagcattagtatctagatatcctattgcaaatttggggctctttttattacattgtctataattccactgacttttttttctaaagagcattattaaaaaaatcagttgccgattgcttttgagtagcataccgaaagaacaaaggtcttaggattggataatcaatgtaatgaatatttataagactatttgtaaatggattttgactaatacaaatagatctggtagcaatattgtttcataacatatatctgtgaatggtgttttagtatcttaggggttggggcttccttgctgaggactcagctaagtaagaaagccagtgcattatttttggactcagaatagaccaatgtgaaggtattaacaagagtaaagacggcaataagagggttgagctattttagcttttccctcaagtaagttttaacttttgcttaaaaacattaattttaaggatgtctattttgtttttgaggccactgtgccaccaggttatttattaaaacaattaatgattaatttactatttttctgccaatgaaagagctaggattcataggtttaattatggctgtgtcagttgctctttatggaggctttggcaagtaatttaaattctgaatctaacaaatttcctaagaatggattaactagtagttctaggtacatactgtaaagtatatataggaaactaaaatttagataagacatatttggtttggcgagctgtaaggagttaatagttttaataaactgtgttcaggataatgtgagtgtaagatatgttcagctgaaagtaaagaaaatgattaaacaaaaatatgaaataaacaacaacaaaaaggaacgagtaaacgaaaatgcagtccagcagcaacaatatgctagaaagttggaggaaaccctgaaaaatggaaagctgttgggaccagactaatgggaaaaagtactgaaggggaaagttggaatcttttcgaagaaaatgattaatagcatgcacaaagatgtcctggaatgtttatcacatcagtacgagtcatagaatttggaagcaaactttcctttcaccaacacgtcttgttttaataaatcatgatatatcaatactttggaacattatgtagccattaaaatgatgttactcaattatatctattcatatcaaagctgcaaaatcacacttaaattattcaataaaaatttatttagccccttctaggcattggacactattatgtgtactagaggttcaatgataaactcaaagtagtcctgctttgagtttattgtctattaaatagaaaacagtcatcaggtacatatgcagattagtgagtgtaaagttacaactgtgaaaacattcttaaaagcctcatcttaaggaagtgtgcaaagtggggtctggatctaattggggatttgaatgggctttcctgaaatctgaaggatgaaagaattgagttaactatgtgaaagttagggggtaaaaatttaagggaggggagaaaaaaggtcatatgaccatatggatttttgctccttagaaattgaaataagatttctgtggctggaggttagaaagtaatctgtgaatgtaggataaagttgaatcagaaaaaggaatattaaaaatttgctaggtgagtttctctaagtttcctcatataagcgagatattattcacagaagcagtgagtagaatggtggatacctggagctggagggaaggtggggaggttggggagatgatcgtcaaaggacataaaatttcagttagaggaataaagtcaagagattaattgtacaacatggtgattgtagttaataacaatgtattatatatttgaaaatcactaacagtaatttttaagtgttctcatcacatacacacaataatcatgtgagataatataattgtaatttgttaaatttagcgttatacaaggtatatttattttttaaaatcatgttatataccataaatatatccaattcttgtctttttaaaaaataaaattgctgggtgacaaatattgaatgcttaccgcatgttgaacattaagaatgatcacactaagaactctcaatagcttttgagacaggtatgagtatcatttgcatttctccagataagtacactaggatgaaactaaacccatgtcacacagtactgccagagctagggtttgaatccagactgaatagcaatcactgtgctacactcatcttttgggtaggagatagtccataggtctattttaaatgttctggattttgatttttatcctaaaataagataacaagcattggcaagttgccatttttttgataaattcttaaggcatttgtggggaggaatattcaagtggagagaaagagaaagtaaaggaggccagcgagaaagctattaaataatgcagaggagaggtcatgatagctcgctccaagagggaagattagagatggagggaagaagacaggttgcagagacgcagaacaggtgaaattgcatggtactccataatggacctgctggggtgcaacgtgagaggccgatctcaggtctgtgtggaggatgacaacctgccttgagataggcagcactgaacaaagggcccgatgactatgagtgtgttctttttttttcttattgagtgcttcgaaacacttatatattgaagtcaaaccgcatgaatgtgtgtgtgtgtgtgtgcgtgtgtgtgtgtgtgtgtatgcatgtatatctggaactcagggaagtttactgagctggggatagatttgccaatcatctatgggtagttaggaattagaactatgggtatcaatgaagtttcctagggacatacatgaatgaatagagatgaacataataaatcaagtattaatagtaattatttctctgttataattataggtattctttgtgctagttttctttatttgtatttttgttttactttaatcagcatatattgatttttgtgggaaaaaaattgaaaaagattttttttttcaattgagaagaaaaagtttattgtatatggcaaagggtagaggagaagagaaccaagatggacccggggttttgtgtctggatcaaaaggcttttctcctctcattttgcactgtttaccccactcagtttggcgctaccttttattactcactagcagtatcatttccatcaaaactctaatttttaaatattttttggacagtaatgttagctgttatcagaagttgtcaacagaacttaaattcaattttacttatactttaacatacaggctgcacatgctaaatgcttgtcacttagaatgctgttctcattagtctggattgcagattttgttgtcatgatgatatgtctggcaacattctcatagtgggtgagctcgactgtctagggattatcttctattacagttcagtttatcatgctctgtttgatatgttctttattaagaaacttaattacctatagttctagatattatgtgctaatgagttgtacgtgtgagtaaatgtattccgaactcatttttggctgctgatatatttctacaaagatgctttgagaaaaagaagcgataagatctgcttccattcttggtcagaaaagttgccacttagtcataatgtggctttattccatgtttccatgaaattcatttgagacatagtaaactcatatttttgaatttaatatttgtaagcacactgtcagttatccacatagtcaagtaaaacttagccgtgaacaaaatctttgaactgtaatgtcatattgtgtcaggtaatcttattcagctatgaaatacttaatactttaaaaatgacactttattgagcacttctatgtataacagtgtttagtaaaatgtttattttgactacttactatagttacatcaatttggtatttccagcagtagtcagaggaagcacaatttaattaaatatgtggatggagaaaattgatttcagagcaaagtttcttgtttcagattacttgtttggatctcagattttgcgtgttgttaagggacttacatttgtataaccaattgtaataaatgaagatttccatgaggcatatggttgcattcatttcggaagaactacagatttcaagtaaaacaaaacaaaacacagaaatcactgaaccaaggcacatttattgagtacagacatcaaacaaatctcatttttgtattaaaatctaaaaattccatataaatagctatgtttgtaggttgttctcttaggctaaaaataaagacagatattgcatctttcatcaacctaacatcaagatatttgcgtgggaccaatcttctcaagatttgattttaaattgttgcttagtcttattcaaattgcatgtatccttccctctcaaggtacataaaatgaaatgttctgaaaagacaattatgtgaatatgggagattctagggacttacagactctactaattttagcaataatttttttctcatagtgaggtccattttcagagtacattaaatcatgtatgaatagtcttcatctttcagtaaagaaactgattcttccagttgaaatttaaactttcttttactctctttttcttttttctgttgtcaacttcattgaaatgtaatttgcatacagtgaagttcatccttcttagtgaacagttctgagttttggcagctatatatatctgctgccactattaggatacagaatagttagcccaaactccctcttgccccactttagtcacctttccttgactctcactctttggtaggcgccaatatgttttttgttcagatagttttgctttagcagattgttatataaataaaatcagacaatatgtagcctttcaggattggtttccaaagttcatctaatgcatttgagattcgtgcatgctgtggtgtgtgtatcagtctctgttttcttttaatgcagaatagtatcccattatatggatatgccatagtttgttcagccattttatgctttctttttattctcttttttcaaaattaattatttatttatattaattttgtgggtacataatagttgtatatatttatgagatacatccgatttcttttttttccttttttttttttttggagacagggtggtagtctgtcacccaggctagagtgcagtagtgtgatcgtggctctctgcagcctggaccaccctggactcaaccaattctcctgctacggcctcctgagtggttgggactacaggtgtgcactattatgccttgctgatttttttgtgtatttatacatatattttttgttgttgttgttgacatggggttttgcaaaattgacagactggtgttaaactactgggctcaagtggtctgtgtgtcttggcctaccaaagtactgggactacaggtgtgagccactgcacccggccctatacatggggtacaggagatgcttgatacaggaatacaatgcataccagtcatatcagggtaaatggggtgtccagcaccttaagcatttaccctttctttgtgttacagactataaaattatactcttttagttattttaaaatatagaatagattattgttactgtagttaccctgttttgctatcaaatatagatcttattcaccctatctaactatatttttgtacccactaacaaaacccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtataagtacaacaatttcttcatccactcatctgttgatggacacttaggttgcttccaaattttggctattttgaatagggctgcaataaacatagaagtgcaggtatccctgtgatacactgatttcctttcttttgggtgtatacttggtggtggggttgctggatcttataatagctctatttttagtcttttaaggaacctccaactgtttgccatagtgcttgtactaatttacattcccaccaacagtgtacaagggtccccttttctaaatatccttgccagcacttattactgcctgtcttttgaataaaagccattttaactgggatgtgatgatatctcattgtagctttgatttgcatatctctgatgatcagtgatgttgagcatctattcatacacctgtttgccatttgtagtcttcttttaagaggtgtctattagatcttcgcccatttttaattgcattattagactttttccctatatagttgtttgagctccttatgtaatctggttattaatctcttatcagatggatagtctgaaaatctgttcccccattctgtaggttgtctcttcactttgttgattgtttcctttgctgtgcagaagctttttaacttgatatgattccatttgtccatctttgctttcgttgcgcatgcttgttgattattactcaagaaatctttgccaactacaatgtcctgattcctcagtggtttttgtttcttgtttttgtacagtagtttcatagtttgaggtcttagattttagtcttttatccatgtttatttgatttttatatacagatctagtcttattctgcatgtggatatccagtttctccatcatcatttattgaagagattgttcttaggacctttgtcgaaaatgaattcactgtatatgtataaatttgtttctgagttctcctattctattctattctattctattctattctattctattctattctattctattctattctattggtctatgtttctttttatgccagtagcatgttgtttgttcactatagctctgaagtataatttgaagtctggtaatgtaatttctccattttttcttttcttttctttcttttttttttttggcttaggatagctttggctattctgggtcttttgtgattccacgtaaattttaggattgtatttcctatttctgtgaagaatggcattcgtattttgataggaattgcactgaatctccagattcctttgagtagtgtggacattttaacaatattgattcttcgagcccatgaacacggaatatctttgtatttttcttgggtctccttcagtttcttttatcaatgttttacagtttttattgtagaaattgtttgttctttttgttgttgttgttacttcctagctattttattttatttccggctattgtaaatgggattactttcttgatttctttttcagattgtttattctgggcatatagaaatggctattttaatgttgattttatgtcttgcagctttactgaatttgtttattagtttgaatagtccttggtggagtctttaggtttttccaaatataagattatatcatctgcaaagatgatttgacttttttctttccaagttgaatgcccttcagttctttctcttgtctgattgatttagctaggacttcctactttattttcattttgtaggtagtatttctgccatgaacactaggattatattaacattttaactagttgctgttgtatctacttttattttattttagaacttttccaatgagttgttatgattgtagactttctaattgaagagctttttatttattaaattatttgtaaacatttcaattgtaataagtattgcatttaatgaaaaatgaattgctttagaaaatattctattaaaattctagagatatgttaatgatttatttgttgtattttttggtatgctttttccggtaaaaaaattaattatgaaaaattggaaacaacagacacgtataaggaagaaaaatccatagtattctaacatggctcatagtttgctggaaagtaattacaaattttttcagtctctaatatctgcaatatcaatctcaaagattgagaacttctggcacaccatagttggaaattttaaaagtaaagccaaaattagctaatttagttaagtgagttaggggaagcaaggtgaacctatggagtacagataagaaaacacacttcagtgttcaagacatcaaaaagaaaaaaaagaggaaagaaaaatatatttcattatttgaactagattacattcttccctggagttccctacttttgttatcctgcataactgtgttttaagtagggttaaaactaagatatttcaaattctgtagtagaaaaaaaatagtctggtattatagattaaaaaaatgaattaaatataattattaatctaagttatgaagcctaaaaaattctaactcatttgtttaaaacacgaatgtccatattcttttactttattccatgatatatgaaagtataatagcatgcattctatttataaacatctatgtttatcttaaggtacatatgctaatgaacatttacaaattgcatcccttacattttgctatgaagaatttaaagcacatactttacagtttgattcatattaatacttaaggtctttttcatacaagttgtacctacattaaaaattagaaggggtcttagaagtcatcttagtccaagtaccttatttttctggagaagaaattcatctcttaaatggttagtgaatagaaaagtttaaatagatacaaggatccctagtttcaatacaaaataatttcgcctataacatcactgggatgcaatgaatctcaccaaaaataattttctatatgtctgtttgtaacaagcgttagcccccaagtattttaatcaagaagtagcgatatatgaaagaaatccagtcttgtggttcactcttttctgtgactctcaccatttccctccctctatgctcccaccacagtatttgggatcagctccaccttatctcttgtcaggccagtacttctcacaccttagaggatatgagagtcatctggagaatcagtaatgagcacaaattagaatagggcctgggcctgtggatttgcaccaacttttgtgggtgagttttatgccccctaaagaaatcactggtgtagactcctgcatgtgcttccacataagccccttcctctccagcctttctcattcgtctcgaatcaagaggacgtactttggctggcacaagccttctaactgcctagtccattgtattgttccaaacaagttaatggcatgcactgaactgagacacactttccaccttggcatcggaaggctcccctgtaacattctagcctgggtctctactccagcatgactgaactccggccctttaagaggaagcattaaaagtgtgatttctgttctcagaaacttgagttaagcttatagttactactaagagaaatgttctgagcttcaccatttttctggaaaaaaaaaaaggtttttaggtgctttgaatatgatacataaaagctgggtatgggggagaaggcacttagcaaacttggggatgataatatgataggctggtcacctttctgtttaattattttgcttacaatgtttcactgaccataggttttgaacttatacatgcttcaatcttcagttttgatttcactacttccttgtgccttctgatttcccttgctgtgtgctttcttactcttctgaacatgtatagagttgtcatatagccactggaaaaaaaattctgccatatatgagtgctcgtatgcattctgcattatcctcacacaaggcaagggagctgatttcatttccttttgtaatcactgcacatgacaagttcccaaaatacatattgaatgaagtcaatgaatacacttattttgaactcttaatctttataaacattaatattttctggtaatcataataacagctgctgtttattcagtagttaacatgtgccagccttggtgctaagtgttctgtgtatgttattattatgttcttagaacaactaccccgagatgcaagtattttaattccatttcatgtatggggcagtttgaagctcagtaaaaaaataccttaatcacttgcaatagctaataaggactagagttgagaactaaatataaactcctagcaactttatcgatagtgtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatgcagtcccgtgtgtgattataagacctctttctcccttccagtctttccctggttcagaaaagacttgactccataggcatcatttggagctggagaagacctgttcttttcccatcgccttcatgtgctccttgctttccccctggtggttctactttatagaggacattcaaatgggagttcactctgggatccattggatagtttttcttagggactctgggtctcccctagagtttcctggaatgagcacttagtctctgcaaagaaaaattgacagcagagtctgccacaataaaaatttctactcaagtttgtagccctcttgtgggcgtggacaggatgatactccatagaatttccacagcatccttttcactcatggaaaactcactcacctttgccacaccaaatgtgggatgcaggcttttccccatcttccacacacataccccatttctgctcacctgtctctcccttagcccttcttctgcccagtagtatcaggtggatttaaagcttagaaagttctagaactaagagataaatcagccttcaaaacagtaggaagttaaatggaggtagtgggggaaatgcttttcaaggtacctttatcttgaagaaagggacattttaataagcaatagaataatgatgaagaagtggttgtattccctcaaattcacttattcccaagttttatagatctgtgtttattatattttttctgcagcccacacttagaaataatttttgcattacaatcaagttggctctctctccctctctctccttttctcacacatcacatacctgaaataataatagtaaactcagcattcacctattttatataccctgcactatgtttccttttcttcttctatccagtactatcagtgtttaacttgcttgtttcgtgacccacaaaactgattagataaccttaacctttgcatgcgtcacgtttcacaatttataaagcactgctgtagaaggtaaagactaataaacgtgttggttgacctttcttcccttgtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggtagctgtgtatgcatgcacttacatttcctaaaccagttttattgtttttcctgaacatacatgcttgttgtttaaaaaaaactgttctgaaatatataattctttctcattcctgcagagtaatcactaattcaggtcttttttaagtcctacttaatacatataagcacccacgcatgcttatactttagtagtctttttgtttctatcacggtcttgtttattctaaaagttgatcattggagagaaggtgaccttgacatgaaagtcggctcttgcttcaaagtctaaactgggacctccttgctgccttgaagggtaaatttatgatctctctgggataagaacatgatctttagactctattaacttttatccaacttctttctcatttaacatgaaaatgcttaggtttttgtttttaaccttgttttttagctttcattgtgcacttgctgatttcgttctcagtgtgacctcttaaatatccaaagggaaaggaaaattgctttagaaaacctctgtgcaaggaagttcagagaattggacttacctttgtaagaataatatgagctggatatagtttactgggacacaaaaatctgcatataccaagggagtgggacaatagacgtaatgatgtgaatggtaaaaataataaagaggactttgcctcatttattgattttttcaagtattttccatctgagttactgagtacagatctcttcctttcaatttacaaaaactaaaagaactaaagataggcaattatttgtggtacagatgcatttacaacaatataattctgttttaaaatcaagttgccttactcatttcaaagctaaggttgtgatggcatttctggaaattctccaatttatcttaaagttgacagtttttttttgtttgtttttttggtgggggtggtgggtgtggagaccgagtctcactctgttgaccaggctggagtgcagtggtgcaatcccagctcactgcaacctccacctccctgattcaagcgattgtcctgcctctgcctcctgaatagttggggttacaggtgcatgccaacacacccagctaattttgtatatttagcagagatgggatttcaccatgttagccaggctgatctcgaactcctggcctctggtgatccacccaccttggcctccgaaagtgctgggaatacagacatgagccactgcgcagccaagctgacgtttcttacagctattgcctcaaataagtacacgatggaggatgtccttatggcttaagtctgcctcatagacgattgttcagtgaaacacttaaattactccctaagtctcaactctaattccttaggtcataactaaaaaatttacttttggctaaggagtgcaagaaacagacaagcaaccaaaacaaaacctatacatactccccctccaaacacacaccaagattctctttaatattcattatgataattgtaaccatataaggagttctttttgcgtgtctgacagtatgctatacattgtcactaaacccccaaagaaaacttagaggtattattactaagttacagataaaatttttttaaaaagatttaagttgttctaacgtcacgttggtgaagattttaacccatctttcagaatataccatggacatagttgtcaggcaagcaagttagtgtagagatgcctttcattgtttaatggtaggtgctcttttagatgtctggtaggaacccaatagttatcttgtttattaataataacaggatcaagaggggaagtcattttctttggttctcttatttccaagcaacatttctgcattagtaatgaactccttaaacaaacactgaggattcttattagctttctttttctatggcaaacattattaactgatcacggcatctttacactggaagggctgggcagcagaagcttccacagaaggctctctggccagacaccaccaatcaattattgaaggtatcaaaattaaaaccaatgtgccatttctgcctttttctatcctatgactctcttacactgaggattagaaagacaattttgaatttttcacttaagtcttaagagacatgttgatttgcaagaggtatttatgaggtgttatgcagagtaagctagttaactctgatatcctctctcatggagactaagtaagttggctttccctgttaaggaaaatagtgttaacatctgcatttcacagtgagttaagaattttcgggaatggggcattacatttacggcctaggttctgaaattgtacatgaacaatttgagctcaaagattacaatgttgaaaatcagtgattttctaacagctccttaatgtatagcagcagcaacagccatcacaataataatataacttttccaggttcctactatgaagctaagctctatacagacaaagcttattttattgtactttgtgttattgtgctttgcagacaatgcattttttttttccaaatgaaaaatttttggcatcatttttgcagcagtatatgcctaattcatgtgtttgggtcacattttgggaaatctcagaatatttcaaattaattcattattattgtatctgttattgtgatctgtgatcagtgatctttgatgttactctcataattcttttggagtgccatgaaccatgtcagtataaaacagcaaagttaatcaataaatgttgtgtgtgttctggctgctccaccgactagctgttgccccatctatctccttttccgcaggcctccatactccctgatacacagcaactttgaaattatggcaattaataatcctatagtcacctctaagtactcaagttaaaggaagagtcacacatctctcaatataaatcaaaagcaagaaaagattaagcttaatgaggaaggcatgtcaatagccaagacaggccaaaagctaggcctcttggttcagttatccaagttgtgaatgcaaaggaaaacttcttgaaagaaattaaaagtgctactccagtgaatgcacaaatgataaagcaaaacagccttattgctgatatgaagaaagttttaatggtctgtatagatcagagcagccacaacattcccttgagccaaagcctaattccagagcaaggccgtaactcccttcagttctataaaggctgagagagatgaggaaattgcaaaggaaaactttgaagttagcagagtttggttcatgaggtttaaggaaagacactgtctccataacatcaaagtgcaagctgaagcagcaagtgctgttatagaaatcacagcaaaccggttatccagaagatgtatctgagatcattgctgaagttggccacactagacaacaaattttcagtgtagccaaaacagccttctattggaagaagatggcgtctaggaattttagagccagagagaagctgatgcctctcttcaaagcttcaaaggacaggctgactcttttgttagaggctgatggagctgacagctttaaaatgaagccagtgctcatgtatctttctgaaaaccctaaggaccttaagagttaggctgactgtgctctacaaatggaacaacaaaccctggatgatagtacctctgcttgcagcacagtttactcaatatttttaagcccacgattgaaacctactgcttaaagaaacaacattttctgtcaaaatatacctgctcattaacaatgcacctggttacccaagagctctgatggagaggtgcaaggagaataatgttttcaggcctgccagcacaacattcattgtacagcccttgagttaaggataattttgtatttcaaatcttattttttcaaaagttgattccaaccctcatgaatgactttgagtggctcgagactttagtgaaggaattagctgcagaggtggtggaaataaaaagataactaaaattagaagtggagtctccagaagttcctgaattgctgtactctcatgataaaacctaagtggataaggatttacttcttatggatgagcaaagatggaatttactcccagtaaatacgatgtgaacattgttgaaatgacagcaaaggatttagaatattatataaagttggttgataaagcagtggtagattgtattagtcagtctagagggacagaactaataggagatatatatgtatatataaaagggagtttattaggtagcattaactcacacgatcacaaggtcccatcataggccatctgcaagctgaggagcaaggaagccagtccaagtcccaaagctgaagaacttggagtccgattttcaagggaaggaagcatccaacacaggagaaagatgtaggctgggaggctaagccaatctagcctttttatgtttttctgcctgctttatgttctggcagcactggcagctgattagatggtgccccccccagattaagggtgggtctacctttcccagcccactgactcaactgttaatctcctttgacaacaccctcacagacatatccaggatcaatagcttgcatccttcaatcaaattaagtcgacactcaatattaaccatcccatggaatttgaaagggtagactctaatcttgaaagaagttcaactgtgggaaaaatgctatcaaacagcatcacatgccacagataaatactttgcaaaggaaaagtcaatcaatgtggcaaaatccatcgtcttaatttttgaaattttcatagccaccccaacattcagcaaccaacaccctgatcagtcagcagctagtaatagcaaggcaagttcctccaccagcaaaacatttagactcactaaaggctcagatgattgttagcattttttggcaataaagtgttttctaattaggatatgtccactttttttagatgtaatgctgttgcacactagtagaccacagtataatataaacataacttttttttattatactttaagttctgggatacatgtgcagaacgtgcaggtttgttgcataggtatacacatgccatggtggtttgccacacccatcaacccatcatatacattaggtatttctcctaatgctatccctctcctagccccccaccctccgacaggccccagtatgtgatgttcccctccttgtgtccatgcgttctcattgttcaactcccactaatgagtgagaacatgcagtgtttgattttctgttcccgtgttagtttgctgagaatcatggtttccagcttcatctgtgtccctgcaaaggacatgaactcatccttttttatggttgcatagtattccatggtgaatatgtgccacagtttctttatccagtctatcattgatggacattagagttggttccaagtctttgctgttgtgaatagagctgcaataaacatacgtgtgcatgtgtctttatagtaggatgatttataatcctttggatatacacccagtaatgggattgctgagtcaaatgatatttctggttgtagatccttgaggaatcaccacagtgtcttccacagttgttgaactaatttgcactcccaccaacagtgtaaaagtgttcctgtttctccacatcctctccagcatctgttatttcctgactttttaatgatcaccattctaactggtatgagatggtatctcattgtggttttgatttgcatttctctaacgaccagtgatgatgagctttttttcatatgtttgttgaccgcataaatgtcttcttttgagaagtatctgttcatatcctttgaccactttttgatggggttgtttgtttttttcttgtaaatttgtttaagttctttgtagattctggatattagcctttagtctgatgattctggatattagctctttgtctgatggagagattgcaaaaattttttccaattctgtaggttatctgttcactctgctcatagtttcttttgctgtgcagaagctctttagcgtcagcatgacttttaaacgcactaagaaaccaaaaatgtatgtgacttgcatcatcacgatatttgctttattggggtgatatggagtcgaacccacaatgtcttcaaagtatgcccatactaagtacccactccttatacactcaattttcacaacaatcttgtaagataattttattctttataagtcaaaacaaaatatttacagttcaggcttcagtaacttgcttatcagcaacacagctacacttctcaactgaataccaaggctgccttttcctctaaagttgtaatgtgacatagtactaaatgataccagagacttttcatggcaaacctataaaaaaagtagtgttggtcgggcgcagtggctcacgcctgtaatcccagcactttgggagtccaaggcaggcagatcacgaggtcaggagttcgagaccagtctgaccaacatggtaaaaccccgccactactaaaaatacaaaaattagctgggcgtggtggcaggcacctgtaattccagctactcaggaggctgagacaggagaattgcttgaacccgggaggcggaggttccagtgagctgagatcgtgctactgcattccagcctgggcgacagagcgagactctatctcaaaataaataaataaataaataagtagtgtttctaatatctctcaggctgtctttaaaactgcatgtttaaacagtttgctagactaatatgttcagtatccttggtagttgtaagtttcttgtatcttctttctttactctttctctgcaaaagcataatccatctcattgctgatattctcagattctaatctggtacaggttaacaatataaagcagtatgcacttattcacaaaataatatatatttgtagattttgtgattcacaataaatcagtaatagcatattgctctctctctcccctactggccttggtgatagttgttctgggaattctataaaccatggcatcatcatgagagagacacacaggctttctttctgatgttaatcaaaccatttctatttcttcatagcttttcattagatggattttggctttatgtaatacagaaacacatcttacttttaaattgaactgtatgattttaatttattcttcatctttgctaattgttttactttggtcaaatctgaaaatccttctatacctcagaaatgtatctggaaaaatggggataaacataaatcacagggttatcataaagattttaatatactagtgaggaattcctttgaaattgagtatgcattgactgctattgttattactagaacgacttggaagtggacatgaatcatttttaaatagttgtttggtggtacagtttttttaaaaaaaatttctataggtttttgggggcaggtagtatttggttgcatgagtaagttctttagtggtgatttgtgagattttggtgcacccatgacccaagcagtatacactgtacccaatttgtagcgttttatccctcatgctcttcccaccctttccccctgagtcctcaaagtccattgtatcattcttatgtctttgcatcctcatagttgagttctcgcttatgagtgagaacatacaatgtttggtttctcatccctgaattacttcacttggagtgataatctccaatcccatccaggttgctgtgaatgccattaattcacatttttttttcttttatggctgagtagtatcccatcatgtatatatcccacagtttttttatccactcatcgattgatgggcatttgggctcgttccatatttctgcaattgcaaattgtgctgctataagcatgcgtgtgcaagtatcttttttgtataatggcttcttttcctctgggtagatacccaacagtgtgattgctggatcaaatggtaattctacttttagttctttaagggctctccacactgttttccatagtggttgtgctagtttacattactaccagcagtgtagaggtgttcccatttcaccacatccatgccaacatctatttttttttttttttttggttatggccattattgccagagtaaggtggtattgcatttttggttttgattggcgtttccctggtcattagtgagattgagcattttttcacatttgaaaacatagcttagctcccacttataactgggggccatttctatattttcttttaatttttaaatagtttaaaaacataagcaaagctatatagtctcatattttaacaactagcttgaaagtatttaatggaaaaatttatattagtattgcttatgtaaacctttattggtagttggtgatacttctatcactcatgttaaattctcttctcaaataaattatagtgttttataacacacacatacacacacgtgtgcacctaacatttgttgtgatttgctaagtactaggcatataatttgcctcccaatttattacaagtaaggtttatcaaatattttaccactgcataacatggaatatcaccttgccagcctccaatagtatttccttgacaccagctgcctgactgctaaggcgttgacaactatttttgttttaattgtagcaggatcccactcttggtacttgtttaggtattagggtgatttcgatgggcccattaaccctactgactgagcatctcagtggctcaacacagaaaagatgcatttcttgcccatgctatatgtctgaatgactgttgattggctgcaagtcaacagttctaaaataaaactatgcttagctttaaaaaaataaaataagggtcagtaaaatatctagttatttttctttatttttattttctcacattttcatttaattttacattattttataaatataactgtacaaactgtaaagccagttatttgctaaagagttttttgataaaacaaaatgattgagtagaaaatctcaccatgatctttgacttacttaatggtagttacagaaaacaatttatataaattaaaaggccatacatagtccaagcaaccaacaagtatttgactcatacaaatctgtatcatgatgtccattagctcaagatgttgacttttcttctttttcttcttgctggtttttttttaaactattttttttttcatctagccaccagagaatgcttatgggaagttaacataaatatcaaacagtgttttcaaatattgtttatgcttgactgaatagggatttgcacaaagagtggttaaatatatggactaaaatagatgctccccattataaaataatatttggtagattacttataaaatttttcttgttattttgaaacccaaagttgtttatatatatagtcctactttttagatttaagccttttttatgtgtttgctattaactgacttagaaaaagtaataccttaaaataagaaaataaatgcttaggacaataggtagattgaaaattcatttgaaattaaaaaaaatctgtgacatttatttttgtgcatattagttccagaactgaaaataaagccctggcagtctcagtgtctatatatatatatgtgtgtgtatatatatatatatatatatatagagagagagagagagagagagagagagagagagagagagagacatatatatgaatgatatgaatgtgtactatgatacattggcctttttgaattacttttacaattgctatagttaagccataatcatagcaaaatatttcaccaagatgaaaggaatataaaaatgtttctggcattataaaaattgcagtgaagaaattggaacttaaagccaaaacaaatagcttacataattaaaacagagctttgtctgtggtaaattttttggcctggaaatgtgaaatatttcttaattcttgaaagtaatagttgtgaacacttcataaaattatagtgagagagagaatgtgctgtaattagcagctgaagagataaatagaaaatcttgcttagtcgtgtaccttacattttcatcctgacaatgctgaatacattttaatgagaataaaataaattaaaattaaagcatcagcatagattctatatatactgtttttccaatccacattccaagagtacctctgtgtttaccattgctatatatatatgtgtgtgtgtgtgtatatacatgtgtatatatatatgtatgcacatatatatatacatatatatataatttcattagtttgggggaacaggtgttttctgttacatagataagttctttggttctaatttctgagattttggtgtatctgtcacccaagaagtgttcagtgtacccaatgtatagccttttatccctcagctccctcagccccttccccccgagtctccaaagtccatcgtatcattcttatacctttatgttctcatagcttagctcccactaataactgaggacatgtgatatttgattttccatccctgagttacttcacttaaaataatgatctccaactccatttgggttgctataaacgccattattttgttcgtttttatggctgagtggtattctatggtgtatatattccccatcttctttatctattcattggtgaatgggcatttaggctggttcgtatttctgcaattgcaaaaacaaataacctcatcaaaacatgggcaaaggacatgaatagacaattctcaaaagaagataaacaaatggccaacaaacatatgaaaaaaaatgctcaacatcactaattatcagagaaatgcgaattaaaactaatgagataccaccttactcttgcaaaaatggccacaattaaaaaaatcaaaaaataatagatattggcatggatgtggtgaaaagggaacacttttacactgctagtcaaaatgtaaactagtatagccactgtggaaaacagtatggagcttccctaaaaaaccagaagtagaattaccgtttgatccagtaatcccaatattgggtatctacccagaagaaaagaagtcattataagaaaaaaagacccttgcacatgcatgtttataccattgcttttagattttactttgcagacttgtaagaattctgtgatacaatgggaatatgttacttttgttgctgagttttacatgatagatttctgtcatataagtcagcaataaaattaatgattaatgattcttatgacctccttatatatatcttaatgagaccaacattaaagtttggcattaattaaattctgggccaaaaaatatattatttcagacgcagcttgtacatttttttaaattgacttttgagctgatgttaggtttgattagaaaaacatattcaatgagctccaaaagttgtgcttatatgtgatgtcagaaatatccggatactgaatacagaaattgaaatgaaagatggaaacctgaagaagactacttttgaaatagagtgatctaatttttatatttactaccttcaaagcccacctctcactgtatacttttttggggtaaaaaaaaaatgtgcacttcacattcccagttatctacgaactgactagattcatttaaattcattacatagttatcaaaccttcactacgttacaggactgtgctacatactggctagacgacaataatgaagctcattgaaaatatcattagggacacacataatttgctgagctttccaccaatggaattacctaggtgctctggtacatgaagacaaactttattctgcctggggaaagcactggggttttccagaagaggtcatctttggttaagccttaaaagaattggtggattttttcaagtagaggtctttctgagaacactgtaaactgaatgatcagtgtgaacaaatgtatgggccgtaagtggcctcacagagacaggagaaatgtccactagttgagtgtttattgtagcatctgggcgaagtgtgaagagaaacagatgagcagtgtgtcaagtagggaggagaggcgacagaacggagggaaactggaattgtgaggattcagtgtatgggacacacacagatgttgttggggcggtagacaggacttgggaactagatttgaactcttattttactatatgtatacttattttacccattattatacaatgctacatattctgatagtaaaataagtataaccacatctaccatgttcacatcttgaagagggttgaagaaaatcaaatgacgtggcttcgaagtccttcctccgaaccagataggttctgctcagtgagtgagggtgtatttgcctagacatgcaaatgaatgaatgagagaagtgcacgagaaaacctactatcaccaaagacctacgtcagttttcccaaacagctttattagtaatacagctaacatttaaattcaaaaatgataaaatgaggagaaatgcttacatttgtcatttgtattagggatgagtgactacaattgggaaacagagaggaagacatttttgtatttgaattgttgatagatggtaatgctaagaacaggataaagaatggaggagaaaaatgaggagaagctggggagagacttcaggtaggatctactgtttttttacagttggtgaggtgcctgcatgtcctcatcattgagctacaattttgttttgatgtcaaccaaggtgtaaaaactagatcatccgtatacaggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgagaaagggatcattactcttgccccaagagagtcagtggtgtcttgcattgagtacttttcagtggagtggctggagatgaaatacaattgcaggaaattaaagaatgcatggaggtaaaaacaaagaaacagaaatgcagtctacactttcaagaaggttgatgatgatggaaagaaatgtgtttgagaataaaacaccccgtgaaagattagcatgcaaagacaacacaacaaaccaatatactgttttgtttttccctttggtcctattccaactagctaatggtggctgtatagccttcttatatgactcaccatttagtttaggttttctgtctccagggagagcataacatggtaaacccttggaatatcatgtctcctttgctagttttcttctttccagttcaggggattgcagtgatattttccatcattgactgcagcaaagatcccaaaggtggaaatatgcctccctcaaaggtactgatgtcatctccattaggaggaatttctgtataatctcactaaagacaccatgaagatttgtcctgtgttttcagtgtctgatggatgctgctgtaaggcagctcttagtttttatttgcacttttatgctttaatgcaattctccctctctctaggactcaagtatgagtcccacaggagaagggctggcagaggcattaagtgctagaccatgagctgtattgcatcattctttcattcagacctggctcgtggttttaaactatagttgtatactctggcctctttttctttagaagatatttctttcttttttcttttttttaaggggcctctctgactatgcttacagacttctttttctttgtgagtcaatcctgcttgcccatcacaagtactcagattaggctaccaattggagtaacctgctgctacgttagttattacagagggaattgtgttatacagagggaataagttatacagaggtaatgatgaagtaggtaaagttcaaattgctgttctcttgcttttcattgaataagggagggagatggggtaaagggtagcaaactgataatggaaaggaagagtggtgctactttcattaatatctaaaaagcaatagccgacataactgtcttcatgctaaaatcaaaagtgtaagcaatatgataattcttaatactgccatgtgcagatgtaccaatcatgcttgtgttaatgcaccatgtaaccgagaagatgaagaaatcaaagacatgtgattacatccaaagaccaggagaaaatcacgatagtattgaggatactttcaaagtaagtggctaaggaaaattttgctacatctttcatgaatgtcacagaaaaagagacagtttgaaaatggaaatttttccaaatcttattgaagttttgctagtatattttactgagaattgagcaatgatttttgagatcttcattatgctgaagattaaaaataccaagttgttgtttctaaactcatttttttcagagaatagatagcttttcagcatttaatatgtacaataaattgcactgtggcgatacacagatgaatctgacacagtgtctattctatttaattaatgtcctgatataaaacgcactttagaaaacattaagcattataaggggtaaattattgaaggtgttcaaacagattatgttcatatatagcgattaggaaaagccttgtaaaaattttggcattagttggacctttataatagatagcacttagaatggcaagagaaaatatggtgccttccaaatagagggaaccacataaatcacgtggtagaagacacaagcaatgaacatagaatgcatggcctctttttattgggtcgagtgattttatgaaagaagttaagagaaatgaggttgaaaatgcagtttgaggcaagtcatttcataccataataaggagtgtgggttttatctgaaataatttcattgggtaactttaaaacaacttgttaaatgatctgatcggaaattctacatagaagctactgcagatagcaagccttttgagttctactttttttcccctttcaacaacttctacgtaagaagaattaaagtccacagactatcagaattaagggaactttgattttcttcctcaaaatgatgcctactgttaagtatgaaaggttaaccttactccaggaaaggaagagtaaatctatggggtcaggaaggctgttgtggtgaatggataacttaatgaaatgatcaaatagtcctgaatgatgttaattagggcaattttgtattactataattgctttgtatttattgaattattgcaatgggtgagttactagacagaaagaaatctatgcagtacgctgaccaaacactgaaaggatgacagaattggaatgctcttggctgttcaattcactgcttaagcagtctccaaatacattaggctattttttttctttttctctttttcttcttgctcattatctgctcattgtccttggatgggacagttccttatttgagagtatatcacatgttcagatctttttcatataaactttcctggcagacactgattctacaagtgttgtacattgtttaatgattttgtaaaacagatatttactgagagactgcagtaagacagactcattacccaagatcagtgaacccactgcatgcaatagatgaggaagcttctctcccataattccgaactgaaatacaaatgctgcctttagtcgcagaagttaaaaccttaaaagtttgtgttgaatagggaatgtcattgggggacatatcgaaccatgtgttaagatgtgtgaatggaagggtctggagaaaagagagaagattggaagagaaatgtatgggtggtacatgtagggaatagggactcaaagggaatgtctgagcaatgggagacactgtgaggccatgggatgtggcaatggcagcctcagctcatagtacggttacattatttattctttttagttttccagaaaaaaaataatattgccaagtatgccaacctaaataacaactcatgtttcaacactgtattttctaggttgttactggcaacttagaaagcctttactttggaaagagtgcttgagtggtattgaggttcccacattggcttagcaaagtcttctttgataacttacttctagaattatattaatgaacagtagtaacttgctatttcaaacatgatctttatggggaaatgtgtactgaactccagtaaaatgacaacagcatatatgtccacaccatgacagtcttttatgccactggaaaatgttcagaagtggaggcttcctgccagcagtagtggacagaagaatgaaagtaagagtcagattttttggaaaagcatttcatagctttcgtccccggtggctttggaggaatatgccacttctgttactgtgggaagtgcagtcagaaataatagtaacagtggtagctgccagggataggtctgtggactttgggaactgaagtacttgaatttgctatctttatcttgattggaatctatgactattttaaacactttctccaatttacaacggcttctctaagaaaagcttcacagctttctttcagaaaagctttgagaggtaggtttgattggcctagttttattaatgatggctttaaagcatattgagattgaggctgtcactgccaaacatagcacctctctttgtgaggccctatttctccaacatacacatttctcactctctgccactttttcagctgtccagtttctctgctgatctgtaaattcagtcatggaggaagaataagcttaatataatcttcttattagaaagcttttactgcgacaaaaaatccccaggatcttagctctaagtctcttcaacccctgtctataggacctacgtaaagggcaaaagtgtaaaataaataaaaggagataaaatgaggagaggggcaaaaacgaaagaattacttattaggaaaagtaagagaatgtgaaaaagaattatttgcaatgtcaaggtttacatacttctccaggtcaagtttatttttctccaacattattaatgatttattgaatctgaaccccaagcataattctgttctaggcagtgaggagtcataaatatgatagaaaatgttcttaccttcagagtggttacaatgtgatagaaaagtgtatatttataaaatattctaagttatttcaaaatagaattgagaatgtgacaaaagcataggctgtagaaaaaatggttttaggtagattttctctgggcagccccaccttccagtatcagtaaaaaacctgtgttgaaaattgctaccagacaatctctcttgttgagcatgtctaaaaaagtttcatgcctatcagttttgtattctatcacatatcagtatggtgcccttaagcagattccaagaggacctcctcaatcggaacatatcgcctcataaattataggattaatttgttttaaagatgccaactttctctcttattcaggaatgctttttttctgaaaatatacttagaatcttagtagatactctcgtgaatttcatgactaattctaatttgttcaataaactgttgattaaattacataaaatttgggcacactggataataagtacagagaactcatccctgtcccttcaaccttgctgtgggagccactgttcttaattttctaaataattccagtgagtacttttacttaaattatttgaataattccacctgtgcaaacctgactgcaatgggctgttaacctagaaaccctgagtattagattatatctgaaataattgccaagcttattgtttagtttaaccctagtttaactcagatataccaatgcctcattatgtttgttaactctattctgattcttcacatatgattaattatgatttattgagaacatcgttttccctctgtgtttactacagtccacagagtctataggagcggaaatctaatgggtttggtgttcactggagttgttcctttgaaataattaaggctttattttaaacttagcaatagggtaaggactgccagatatttctttatgtacttgaataaaatttgcttaaattcttcaaatctctggtctcaaactaattgatttctctgatgcagtgcttccttctcccaattgtgtgcctttaaatgaaaaatctctcttctaaccctctagctataaggagtttgccaaaggcaaagttgttaaccaagatttttattttgacccatagttccagctttcttttcgttttgacagttaatatgaatatacagaatctcagtgtattaggctattcttgtgttgctataaagcaatatctgagactgggtaatttatgaagaaaagaggtttaactggctctgtaaggtgtacgggaagcatggtgccaacatctggttggcttctggggaggtctcagggagcttacaatcatggaagaaggtgaagcaggagcaggcatatcacatggtgagaacaggagcaggagagggagtgggggaggtgccacacactttaaacaaccagatgttgtgagaggacagcaccaaaccatgagggagccttccctatgacccagattccactagtctctgccttcaacactggggattacatctgcacatgagatttggagggaacatatatccaaactatatcattccaccccgaacctacaatctcatttccttctcacattacaaaatacaaaaatcttgtcccaatagtcccccaatgtcttatttcatcccagcattaactcaaaagtcctaagtccaaagttccatctgagacaaggtgagtcccttacacctatgagcctgcaaattcaaagcaatttatttacttccaagatgaaaggtgggtgcaggcattggataaacatttctgctccaaaaaagagaaactggctaaaagaaaggggccctaggtcccatgcgagtttgaaacctggcaggacagtcattaaacctcaaaacttcaaaataattttgttttactacatgtcccacatccaaggcacactgctgcaaggggttggctcccaagggcttggacagctccacctctgtggccactgctctatcaggctgttgggtgtttttccaagtgcaggatgcaaactgctggtggatctaccattctgaggtctctagggcagtgtcctccttcccccagcttcactaggcaatgccacagtgggaactccttgtgggccctccaaccccatatttcccttctgcacttccctggtagagcttctctttaagggctctgcccctgaagcaggcttctgcctgggcggccaggcttttctatacaccctctgaaatataagtggaagctcccaagccttcttaactcttgtactctgcatgcctgcacgcttaacaccaggtgaaggccactgtgttggtccattctcatgcttctaataaagacatacctgagactgggtaatttataaggaaagaggtttaattgactcacagtacagaattgctggggtggccttgagaaacctacaatcatggtggaaggggaggcaaacatgttcttcacatggaggcaacaaagagagtgccaaagaaaagaggggaaaaccccttataaaactgtcagatctcatgaaaactcactcattatgatgaaaacaggatgaggggagtgaccccccatgattcaattttctccacctgctctctcccatgacacatgaggattatgggaactataattcaagatgagatttgggtggggatatagccaaaccatattattccacccctggaccctcccaaatctcatgtgcttgcaatttaaaatgcagtaacgcccttccaacagtcccgcaaagtcttaactcattccaacattaacccggaaagccaagtccaatgtctcatctgagaaaaggcaagtcccttcttcttatgagcctgtaaaatcaaaagcaagttagttacttcacagatacaatgggagtgcagacattgggtaaatacacccattccagatgggggaaattggccaaaacagaggggctacaggccccacgcaagtctgaaattcaatagggtagtcattaaaccttaaagttccaaaattatctcctttgactccatgtctcagatccaggtcaccctgatgcaagaggtgggctcccacagcatttggccgctccatccctgtggcttttcggggtacaggtgctcttccggctgctttcatgggctggcgttgtctgtggctttacaggtgcccagttcaagctgtcagtggatctgccattctgggatctggaggacagtcgtcctcttctcacagctccactagatagtgaagcaatggggactgtgtgtgggggctccagtcccacatttgccttccacactgccgtaggagaggttctccatgaaggctctgtctgtgcagcatacctctgcctggacaccagggcatttctgtaaatcttctgaaatctaggcggaggttcccaaatctcaacttttgacttctgtgcacctgcaggctcaacaccatgtggaagctctcaaggcttggagcttgcagcctctgtacccgtggcctgagctgtaccttggtcccttttagccgtggctggagtggctaggagacagagcgccgagaccctatgctgcacacagtaggggagccttggcccaggcccacaaaaccatttttccttcctgtgcctcttggcctgtgataggaggggctgccacagaggtctctgacatgccctaaggagactttccccattttcttggtaattaacactctgctccttgttacttatgcaaatttctgtaaccagctttaatttctccccagaaaatggggttttcttttctatcatattgtcgggctgcaaattttccaaacttttacgctctgcttcctctttaattatttgacgcttagaattgtcttctaccagatatcctagatcatctctctcaggttaaaatttccacagatatttagggcaggggcaaaatgctgccagtctctttgcttaagtataacaagtgtcacctttgcttccgtttccaacaagttcttagactactgtggcctgggcgtcattgtccatatcactatcagattttggtcaaaaccattcaacaagtctctagaaagttccaaaccttcccacatcttcctgtcttctgagccctccaagtctctaggaagttccaaagtttcccacattttcctgtcttcttctgtgccctccaaaccgttttgacctttgcctgttacccagttcaaaagccgcttccacgttttcgggtctctttacggcagcacccaactttctgtggtaccaatttactatagtagtttgttctcatgctgctaataaagacatacatgagaccgggtaatttataaaggaaagaagtttaattgactcacagttcagcatggctggggaggcctcaggaaacttacaatcatgatggaaggggaagcaaacacgtctttcttcatatagcggcagcaaggagaagtgccaagcaaaagggggaaaagccatttataaaatcatcagatctcgtgagaattcactcactatcaaaagaacagcatggaggtaaccactcccatgattcaattacctccctctgggtcctttcacagcatgtggggattatggggactacaattcaagatgagatttgagtggagagagccccaaaccttgtcagccaccgaggcttatggcatgccttctctgaagcagcagactgagcagtacctgggaccctctgagcctgtggctggagttggagcagtcaggattcagggagtagtgttccgaggtagtgtatggctctgatactctgggcctggcccatgaaaacattttttctcctaggccaaagggtctttgatgggagtggatacctggaagactgctgaaatgcctttgaggccttttccccattgtcttgtctatcagcacctggctatttttgagtcatgcaaatgtattaagtggttgcttcacagcccacttggattcttcccctgaaaattttctaacacctggccaagctgcagattttttaaacttttacactcttcttccttcttaaacagatgttccaactttaacatcaattatttgctcctgcatctgaatgaaggctgcttgttagaagcagccaggccacatcttgtacacgtggctggttagaaatttcttcccacagatactctaaattatgactctgaagttccaccttccacaaatccttagggcataaacagaatgcagccaagttattcactaaggcacaacatgtatgacctttgctccagttcccagtaggtgccttacttccatctgagaccttgtaagcgtgaaatttcactgtccatgtcatatcagcattttggtctcaaccatttaaccagtctctaagaagttctaaacgtttccttatcttcctgttttcttctgagcccttcaaactcttccaaccctttcctgttacccagttccaaaggttcttccacattttcaggtaatttttagcaataccccactcctcagtacaaattttctgtattaggacattctcgtgttgctgtaaagaaatacctcagatggggcaatttataaagaagagaggtgtaattgactcacagttctgcaggttgtataggaggcatggtgctggtatctacttggcttctgaagcctcagggagctcacaatcatggcagaaggcaagggggaagcaggcatgtcacatggtgaaaacaggagcaaaagagggagtgagggaggtgccacacattttaaacaactagattttgtgagaggacagcaccaagctgtgaaagattcttccttatgtcccagaaaccacccaccaggccccatcttcaacactggggatgatatctgagcatgatatttggagaggccatatatccaaactgtgtcactcagtatggcatttcatctggataggatgtacaactaagtagaagcccccttagtttcagatgttgagtatttttttcctaagttacataacatttggtctacattagtccattcatataacataggtatatgccttgatgatataacctattttgtcttctcgtttaaaatcatttaatagaatggatttcaagtcagtaatgtcaacagaattgaattcaaagttataaagagtcctagaaggggtttttttgttaagagaaggattcaaactgtggaaaagagataggatatatgtagaattccacttgcaattaaaatatatgtaccgttattttctcttttcctctactcttgtgattacttctattccttaaatggaaacagctgtcattaaaacgtgaaaatatttctgtttaaaagcaaatatttattgatgctaaaagcatcaaggaaacaaacacactttcaagttaaatttgttattgtcatggtacactgaaatagattttgttatactttatatgcctgaaattagtatgctatgcaaaaggattagagtgaaagatttaagcaggtcagcagtgaagatgctgccagtagctggtgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaaaaaaaaaaaaaatctttaaaatgttgttaaataaattataattaaattgaaaatcaccctaaattgaatatagaataatttgtaataataaataaacatgcattcaacatgttaaatgagaaaaagcagattgcgcacttcaggtataatgattctattttatttcatgtgcttacacacattgggaggctgagatgggaggatcacttgaggccaggagcttgagaccagcctggataacatagtgagatgagggcatctctactacttagggcacactggcatgctcctgtagtcccagatactgtggaagctgaagtgggaggatcacttgagcctgaggctgcactgagctgtgatagcaccactgcactccagcctgggcaacagagtgaggccctctctcaaaaagtaaataaaaaataaataattgtgcttacatatttatcttaccaatgaagattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaaaaaaaaaaaagaaagaaagaatagcaaaagaaacacacttcatttatttgtacccatattagtaatagtaccttatccagaatgaccctagaaaaccatttacttattgttcattggccaagaacataattacatggccacacttagttgcagggaagtataggaaatatttatagtctgtacctagacatattgctgccctatgtacctagacatattgctgccctaagtactattcttggatgaccatttagcggcctctgtcatgacatatttgtattgaatgaatgatgatattaaaaatacacatatgcataaacatattcacacaaactatatatgatatatgctatatagcataattttattatctatgtgcatttttctttacttacaaatgtttaatttggtcatacttgatttagtatatctaatagtcgttataggtcagtcggtcatatgtttctttttatttataatttaaaatatgttttaccttatataattacacttttaaaaatgatatgtttaaaaactaataaatttgaaaatttatacaattcattcacgcttttccataaaacaacacttctggcattaatgagtcactgctttccataaagtatacataacaattatatgtatttattacacattctatattatattatatatacattaattatgatatataattgtatcatgactatgtataacttcatggtattatgtatataacatcgtggtattattttcaagccttttgttaatatcagactgttttacatagcaattaggaagctagaaatgggttcaaatcattccgttggtaataatttgaacttacttttctttcatggcatgaaagtttttgtgtgctactttttactattcctaaaccaagaaacgtgaagatcatgtgaatgtatttgctgttcaattggaggtcagacgttcaactcaagaaaggcttggcgcaagataaatcactctgctgtgaaatgagtccataaacacaatgcacttgccagccctcaaacaaagtagatttacaagtttttaaaaatctcagtgagaagtactgttgtttccttgagtgtaagttactcttattcatgaatatgtttaaattttagaaaactggaccacaaaagtctatcctaactatagtagtctgtgattaaaatggcaaaagcaaagggtgtatgatttttaagctcattttagtgctattttctagtgttttaaatttttttggtttgttcttaaataggttttaattggaagtgttcttttgagaaatggaactaaaactttgagtggggcagtatacttttaaagtcagagtctatccttgggttcataagttcattcaatttggaaattaaaagtagaggaaactgacaagggagttggggcgtgctgtagaattactctcaaagctaaacatggagttaaaactgtgtcaaaaccataattagtatttgcccttgaattgtccttgttaatagaagtggaacagtggaaaatactgcatagaggcattgtctggaaactgcatttcatagccaataaattcaaaccaccttagtggaatataattatgaggaggagctatagtctctgtggctgaagaaaaaacaacaacaagaacaacaacaacaaaaaacgcagagcatgtcttgctctacattctaacttgcatcatggaatccgccggatctatgccattttggatttcattgccaccggttgaaagtggtagatttctttttcttaagtcggctagaagacctaattttagtaagcctaaagggcactgagcaatacaactactttggtggatcgtttccagtttgaggattcctagtgcacaatcagtgaatgttgtatggaacgcatggtgaagaaatacggtttagtgaatctggaaacttaaaaaaattggccttggcatcgtgaggaattcccatttggccttcagcatttttgtctatgttggcttttctgtcccaagactttctataatccaatttatcacttgctttttgggttaaagggaaataaaatttccacacttcttcaatacatgtgctggagaggacaaggggagggaatttattttgtgtgtgtgttgtaaaatcagaagcaattgttgaaaggtgatgaacagtttgaaaggtatgttgttctcttgtactacatccagtggttactatgaagtttttctcatcactcttttgtatcctttcttaaattctgctgtgtggcagagtatcttatttatctccatattaacatgccttttgcaaggtttagttatattattgcaactgttctcaaaagatacaagcttcctcctaaaacacgtcacaatcaggttttgctagacagctactaacagccttaaattaaacaggatctcaggatgtcttgtcagtttgggttttcagctgcagacagttgacaagggataaagaggacagaactaatgccacatgccatctccctccaaagagagaatccttgacccctgagtttaccattctcatttttgagattccattttcacttctaccacatacaaattgctttccttgtttttaacacagtgaagtaatttgaaaaaaaaatctgataatgtatctcatatctctatgtcttttaataggaagagggcacatattaattcaacgtattcatttgcaagaacacaaaatcctggacttttttttttaacttactgatcattatatatctgagaaatttggtgtaacaccaagtcttttgtcatcagtagctcccattttttaaagacttctatctctatattcaataaatgtcacaattatttgctatcattattttaatatgtttactattatttttattttaaaatatgttctcattttcatatacttactattttatttttagtttaaaaatattttttcagaaacctaaaatgtcagtgaatacaggtaaatatttattcattttgactacatagaaatctaaagcaaatattgattgtgatatgtacatctacatattaatataacatttttataaacgtattgtttctgtttcaaacatgagtcttggtcaataattgatataaataaaaattcaagttttccacaaaattttgcttatgtaaaattaaataaggtaacctttatattcagtcagttctggctcctggataaattgcatgcttagaaatttcactttaataaaataaaagttttctcctcatctgtaatgtattctcccttttactgtactggcatctacatattgactgttttcatgaattatttcttcccaagatccctacaaagaagtaaaactcattcataatagattgtatattaatccccaaattccatgtaattctacagaaggaaaaaaacataaaccaaaatcatggtacttgcagtggaagaagcataagcatcctacatttatacccttttccccataaatacatagtgtgactggcagcctgcacagtaatgattaaatgagacaataaaatcttagcaattcttaccctgagtctggaagtgattaccgtgtccaagagcaagtcatttcctttttctaggtgtagtttttttattctacaaaatactaggaagagattatctccaacagaagtcacatcttctgggtcaaattaggatcacaaacatgtgtttgtgtattaaaatgttttaaatttgaatcagctgacaatacttcaaaaattgggagatttgatattaatatcttgtaacacataatgggtaaaagactgcccctggcaaaagcctgcatctctggttctccagaagccccacccttcccccttgctaccagtcacttaaaccaagtctgtgttgtggcttaatgtctaattgcctttttatttaaaattctgactttggcccctggcctagaatgaccattaatggtatatttagccatgatatctatgattctttaaccaataactgcttaaggctatccttgccttgatgtttctcccagagcttgcctagtcaagcttcatcctcttagttaattatggtcctctatagaatatgtgctattctgtcttttaaaggcttttccagggatacatttgacatatttaaacatgatagctaggtaagctgtttcaaaggcattatcctccataaacattctactcttgtataaaaagtcatttcaaaatatactattttactagatttattcatgattaagtcaagagttgctccatcggattagtatttattttcaattgccttccttatatacatgttagatagcgttgcactctgaaactggatttgaaactttatttttttctttataaaatattagtgcaaaaatcacaaagggattcaaaacacacacacacacacacatactcattattcaatagattttgtatgtttgaattcaagaaatgatgagttataagttatatctgaaatgtccaggagagtgggtcttaattcagaaagaaaaaaatggaaggtagttaaaaatgatttccatagtaaatactcaatagaattattcactaagaagaaggaaattatgttgaaaacttaaacttttgaggcttttcaagagtgttaacaggtatctgtgacatattttttagtactttaatttggtggacatattcttataatctgagttacaaatcaatttattaaaacttcaattagtttttgtgaaaataatgctgtacaataaatgatgcaaaatgtcaattgactaaccaccgacaaaatttatccctcactgaaattcctgtatgttgttaatgtgtccctgctttgggctgtaggttgggttcaggtatctatgtgtcttttaatctggagcctatcctttgctggggaataatatttgtacaggatagggcaggatcgcataaacaagtcaaaccacacatgtgcatctacatcctggttggatacagcttattatattaactcacattcgattagttgaagcaagtcacaaggtcaagctcaaagtcagtgaagaggagcattatagaggcattgtggctaaaccacaataagccatttcaatgtggggaaggaaggaagaattgtgaacacataatactatctgtcacatgaaatatgcttggtaatttgcattattttggatatttcacataacaaattcaaaatatagcttgagaaagataatagacaaagatgtcacatattttggaatgatgtttaagaaagatgatgctgtttcagttctgtaagctcttaatatttatcaatatgtcatctttgttttaaaatgtaaagctttatctacatgatgattgtgaaaagtgggtaccaagttttgggctatgtaatagtacatgaaaggaaatagtcataagaaaatcatgaatttagaaaaacaccattgcattgatagattttattaggggtgtcaaatgtttcagcttataggttagagaaatataagcccctcttttcatactgctatgtggtatgacttgctgttattataaacttctgtacattgcacttgagtttgatgaagatccataaagatttagtcattgaaacataacagccattgtgccacataaccttgggttgaggtctcaattcagagccaacttcagacagcaccatgaataaaatttgatcttgccaatttcacattccccatttctcccattcaatatgtacacatcgatgttcccaatgtctttattttgtcctttggctttggattccatatatatatatatatatatatatgcacacatacatatatatatgattctcctttaatttcactcagtatcctgtcttacccattttgaacatctgtttaataaacagttattattaggcactctgaatttaaataatcaggagacatggttccctaggatggtggtattcaaatgattttacaaaaatcctggcagattataagaaatagattttaattgcagtccactaaatacatacatatacatgcatacatgaagcaaaaatttcacaaataataataaccttactacaggtatacattatgatttattttatttcattgggggtgagtgttggtagccactcactaaatgaatgtcagtccctagtgtttctgaattcagtgtataatagcactttaagattttaggtttaatggtggccagggataagggtcagggaaaggggcagctacacatatctccagtattattaaatgccaaataaatagtgcagataataagtgctgaagtgtttagaaaaaggggccaggcgcggtggctcacgcctgtagtcccagctactggggaggctgaggcaggagaattgcttgaacccgggaggttgagactgcagtgagctcagatcatgccactgcaatccagcctgagcgatggagcgagactctatttcaaaaaaaaaaaaaaaaaatttagaaaatgaagaagcttattttggctaaaatgtaatactagaagttatcaaagatgaagaagaagaggtaggacttgaatttcatattagtgtttcaaaatatattaacatgaggaggtaatttaattattatttaggaatggttatcagcaagacatattttagaagctctgtaatagtttcgagggattaagtataggagttcattttgggaattactgtgagataaacatgaaacgaaggattgattatgtattatatctgaacatgaattccaggccaattatctcaacatttatctttcatgcaatggagattttctttgagtttctgatatggaagctagaatgatgtaaaaaatatttaggaaggggaattcgatatgcaccatggtcacctacgtgctattgtattttttatgtttttcttagatttttcaataaaaattctaccatgtgttttctggggcttgttagcaatttagtaggagttatattgaatagtactttaactcaagtgaaggataactaggtacactcttgagacaggtgttcattggcatatgatgtattcatttcacacattataggttctagccttagaatttttcatgttttaaaagcattattccaagcatccaatgtatgttgcgtttatcccatatgattttgtccagaatggttactgtccacagaggttttatctttgtctgtggtattaagctttttgaggacaatgcaaatggcttcatattcgagaatgataataatttggtcaacttttatgtactgagaaattaattgaagatttcaaaagactaaatagcatgaaatatttataattgctgtatagtgaaaaataatgagagattttcctatccttatacggtattttgcagagggtataagcaaaagctcttgtgatttttattcattttgggggggagaattggataaattatgttatgtgtttaaggtactggtttttgttttattgtaagcaaacttatttactttttatagtgctagtcgttatcaatgccagaggactgctgaattgtcctgttcccacctccagtcctataggacttcaccatctaaaaacaccttagttcccatacagctttgctctagagtctagaaagatgctaatgattatatgctagaaggaatcaagtaatatttggaggaattgttcttgtgtcttctagattatcattttagaagcaaatcatgctttctgtgagatgtccataagtgcctctatcagagacggattataatgctgtggtgttatgggtctgattctgtggggagaatttagcttactaatttcgaacatatatgcaatatgtatcaaatagtaagtgctgcaaagtatgtccctgtgctttaaaagggaattactgaagaaatttctaatttcacaataaaaaatattttagagtagcagggacttgtttttaggaaggaaatctgccatatattagcaagcaccattacattttaaagtgatatttttcaggcatgtaaagagtcaagttcttgaaaataagaacacctttattatcatgtaactgcatttcagcactgcatcgctctctgtattcccctctcctctccttgcctacctctctcacctttatttcactctcttccttctaatcttgtcactttgcttttcctgcactttccttcctcgaggcatttgtttatgcagtttctgtagccccacatgcttattcttctcctataggtaaacacaattccaatttttcaaaatccatctcaaatcacagagccttcacgatggctcccaaagcttccatcagatttaatttgatgtccccatatttgccatagattgtgcttttaaaaattgtagttatccttctctgtcttatttaatggtaatttatgtgtgtccactcatttcataatgctctactgtaggttaaggcctatgtctggctcacaaacatcttactcattgacacagagatttgcatagagcagacaccaaatagatagttacactgaatattttatgaatcatattaaaatctataggtggcttttaaccatactttattgatgttgtttaattagaagtctctctcaaaaacttcatatgctttgatgctggggaggatgcctcactcattgttgtatccgtatttgtaactaacatttattgagttccagttatgtgacagactcctactagctctttgcactttatatggctcatctcattgagttcttagaataacccaccagaataggtgggcagtaatagctgcagtttataggggaaaaaaaattatgagtcagaggctaatttactttccaaggtttgaagaggcagtaagtgacaaaaccaagataaaaactcagaaagcttcattactttctgcaaaccttgaacaatctagtgaatgaacgaatgtgtcttcagagttatgacataaccagcaggagaaagaaaccatcatgcgacttcctaaaatacgatgcattatttctttcaacaaattatttaagtaagtgtactatgcttagtagttatgtgaatcattatcttggattttattaactgtagggctgtagactttggaaagaaagatcctaatactgtgttcaggaatcaatgagaaacaaagatattagtagaaaaatggagtggaagagaggcagtgggtgtatcgattatgtactttggtgattatgatttctatgctatggatatttaaaattttattttcctcttaatcttcaatttccatcttctggtaacttctttagatataagaccaagacactttctttaccgttatatctgctagatttttatccagtgtattttaagaagtcttttttatccagtgccttttaagaagctcagtccgggtgcagtggctcacgcctgtaatcccagcactttaggaggccgaggcggcggatcatgaggtcaggagttcaagaccagcttggccaacatagtgaatacctgtctctactaaaaatacaaaaattagctgggcgtggtggcacgcacctgtagtcccacctactcaggaggctgagacgggagaatcacttgaacccgggaggcagagtttgcagtgagcggagaccacgccattgcactccagcctaggtgacagagtgagactccgtctcaaagaaaaaaagaaaagaaacagaagctcaataagtgttatttgggataaagcattaactggtttaaagctcaagattttaaacaactcaggattgggcattaaagaataacagaagctaccatctattgaatttttattaagacatttcaggacaccaggagtaagaatacagggtagctgtatttgttatctattgctccataacaaataattccagactttctggcttaaaactactcattatctcacagttcctttgactaggaattcagcatctctaatttaaggtctctaaaatgaggttccagttaagcgattgacagggtctgtcgtcttatctcctgataagactaggaggcttgactagtggaggatctgcttccaagcttacttgtggggtctcagttttctgctgtctgtgggccagagctctctttcagttgcttgctatgcaggtggcctcatgggactttctcatgacatggcaactggtttctccatggtgaacagtctaagaatctgtcaagatagaagccacagtgtttttataatctaaattggaagggacattccatcacttctgccactttctattggtttgtagtaagtcagaaagtctagcccacattcaaggaaagaggattatggaagggcataaataccagaaagagaattttgggtgactcccttagaagctgcctatcaaagtacttaccctgccattctgtctacttatcattgtatttctctttaatttgatcttgaggttgtaaagtggctataaactttagccctgccctgatggagttccaggggatttatttggctgtgggtatttatgatgtgcctttcactggatacttctttatcctagtggataacctaattcctgtgcctaacttgttactaggtatacttcacacacacacacacacacacacacacacacacacacacacacacacagacacacacacaaacacttatttatgctggcagactgacagtcacctttgcagctcttgtctgttctgccaagatagtcactctctgggaaagctttgaccagaagaaaaattgggtatggatgtattggtcaggagacgtagagaaggcagcacagcaaaacatatgaagtataagaagcagtttattactcatgagtccacgagagaagacggctactatataggaagcagggggcaaggttgcaggggcaatgtgctgaaccatcagatcaggagcagatagaaagaggacctgtggggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagacaagatttgggactacaaaacattctcgaggtagtgttccaggaagctactgactgtcaattatttaggattggaactccatttgaaatctatttgttctttatattgtttttttttaagtttatcttcattaaaaagctgcaaattaggtattcatttttttattccactttggagaaaacaacaacactaagaaatgtcaaaattaatcattgatatatttgtgaccagtaccttcaaaactagttcaacctactgaaaactactcaagctctttccaccacataatagcactttcagatattgtttttgcagcttaaagggaatttgcatttaggtatgtgtacaatatcaacaaattggtgctacaggcacattcaatgttcttctttttagaggaaattaaattcaatttgattaggttgatgtggacaacattaaaataaatgttaaccttattctgtatttatgaatcaatactgatagttttaagatacctggccattctacttgttggtaaggtcttggaataaggaaatcttgacagaagttttgaagagtatattctttatcatttcaaactgtgaaaactatgcactttcctaagagtagattttaaagtcacacaagggatcatgctgaaaactgacttctagagtctttgctcagcaggttgttgcattttttttctttactattgaacactcttttgttcatgccttttttcttattgcttgcagaaatgtgacaagcttcaaacttacacagaaagaataagtagtagagatactaggtatcattgcacagcccagatgtcttttgaaaatatttattcagctgaactagaatttcaaaatctattagaaaggtaaaatatatcttggaaaacaaaagcagattttgaataaaacataggtaaaaaaacttttaagtaagaaaatatgaaaaaatggcaacagctttaaatgataacttgatggcttccacagaataattcatagtgtaggtattttttattaaaacttgacaaatattctaaaaaatgtaaaagtgaaaattaggtattttaactgagaaagatgaaattggcaccatctaaaaaaattttcatgagttccatttgtgttaagaaaatatttcttatttaatcaaatacatgtgcaaaatgttatcttaaaatccttttagagttttgataaagaatgctcaatatgagcatacatattcagccattagttatattcacattctcttccagaaataatctgttaataattaaatgtgttttataaacacttacataatgaaactcaaattagcttctcagataaattgttgttgctgttgttcagctggtattgttataaaccatcattcatataactttattatattgtgagtgttttctttgaaactgatcaacctcagcatttaggatatgtggactattagatggagaaatgaatatttgccttagcatagtaataaatattgttagactgacacaaatattagcctgcactcatagtgcctaaaataggccattccagtaattgcttagaaaaatattatttgtacagcttgtagaaatttacaaatgaacagaaaaactctgcatttgacctaggatatatgaattcttcaaataataaatatatcaaatatattctgagtttgaaatagtctttaccttgagccaccaaaaaggaaaagaaaatagaatcaagattacttgttaattttcaattttggggtgaaaaaccttattaaacttctccagtaactaaatcacataaagttcttcagtacaagttagattgtggaaatagttcatgtagttattccacgtctccttctaacaaaatatcaacagttcaaatatccagtttccttttcatttatgcaccattgtagttgctaatataaatgttggatctttctgcctcccactcacacctccagcccctcccctgcccacgcacctgcactggctcacattggtgctctttttctgcgggctgcgctgagcagaaaaggtgaggctattcagggttctgtaatgctcaattccatgttccgtttcttttcctcagaaacagttgaaacctatctatggatgaaaaacgcttcataatccaaacattacttcaatcagatgtgaagagtgggtttgctgcactgtaacatgctattattgcttaggtttatttgacaaaagtgaacaaccacaactttcaggaaaaactttttttttttgaattttatgtgagttgtccttttggaaatagatagatgagagagagacagagggacaaataatctgtatgaattttggcttttctcttgagtataaatgtttatctttcccccttcaatgtaacttgcttggatgttcaagtgtggagtacatttcttttctaaaagacaacatatttttcaattttattcattgatttatcactcaaaacatgcacttgaaggtactcttagtactctccttcatggccagtttatctataccgttttttcagagtttcttgagacagcttgcttttttttgtttgtttgtgttttttgttttgaccgagtctccctctgtggcccaggctggagtgcagtgatcttggctcactgcaaactccgcctcccgggttcacactattctcctgcctcagcctcccgagtagctgggactacaggcgcccgccaccatgcctggctaattttttgtatttttagtagagatgggttttcaccgtgttagccaggatggtctcgatctcctgacctcgtgatccgcccgcctcggcctcccaaagtgctgggatgacaggcgtgagccaccgcgcccggcctgaggccgcttgcttttaaagagctctcgcaaacaggtagcataggtgactgccttttgacctaaaatgtgatattttagaatatgttactagaaatttgcaataatgttcttaaaattattaatcttattgatgtgtttctggagcccagtaccaaacactgatcctaaagattgaatttggaacgaggccaatttagtgtttccctaaactgttttgggtagaacgctaataataatgccatgtgcttttactagtatttcatagccaaatacatttggggattacagagttagcccactcgtagccgtcttgtggactgcacggagcctttactgtgcttgcatgcatcatgcacccacctctccgagagtggtgtcatatatgtccattgattggaatgagcaggttactcctgcttccctctgtagagcgcatcatgcagaattgtttgtgtgtgtgtgtgtctgtgtgtgtgtgtgtgtctataccactttggatatcactcagttaacagttattgtctaaatcattcttgtgataagaatgataatcttattatataaatgatagaactatacttgagaatacagcctgattgttttatctatccattttatcattaaaagtgaattgaaaactttactattatgaaccctgtcgtttcctattgaggttctttaacactagaacctgcagaattagccatactttgacattaaaactattacattgccatcctctctttttccctggtgaatatttaggtgcactttgagatctggtattgctctagtggtgtgcctatttttttttaatattttcatttttgtttaatctacagagaagttccgagatcctccagagctctgatgggaagaattgtatagcgtgtcccctgccaaaagttctaataaaaaatttacacagcggaggctttgattaaatgaattattcattgacaactatccatcagggaattagaagtttatggcaacatgagctgtggaaaatagaaagaaaaattacccattactaactttttaaatgagaaagtcagaaactcagattgaatgtgaatttaaccctgcacatggaaagacactatgcaaaatattgagaggagttacataacctttatgcaatttattacttaataagcacataattggctgctaattaacagttgtagcatctttctttcttgtctttcctctcgttaagcgtaatattatgtgtagaactagcatagtgtggtttctgactttaacattcttctgtaagatcacttgtgttcagcacctcgcacagggttctattcacagaatagaatcctattttgttttcttttatattagaaatagtccatggcatcttgacaaggtgttatgaaccagagaggaaaggtcaatgatttaaaccagctttaggagaagcatatatagaagttgtttctcggctttctggaatgaattttaacagccacctataattgaaagcatttcatgcagggcatttcacaaaatggacattcaaaaactacaggttgacctgtactgaagacgtgaaattgctttgtgcctttgagaagtactcttggataaaccatgccattgtctatattgagttccctgattaaataatagtctctctctatctctttatctctctctagctagccatccatctatatatataacacatgcacatactcaaataaatatttacataacgaatctatcgatgtatattagtaagtactatgcattcagcacatgattagggtgcataatctcatatgcacgttgcaaaaatctttgaggggtagtatcattagtaatatttcatatatgacaaaactgaggtttaaagagtttaagggacttttccaagttcacatactaagagaaacagttactatataagtcacgttagccgcaaaggcaagcctttcttctttttttggatattatataaaaattatatagaaaagtttctttttaaacctaagccatgggaacaattcttcagttttcattttattctagtaaatttcttttcttttcttttttttttttttttgagacggagtctcgctctgtcgcccaggctggggcgcagtggcctgatctcggctcactgcaagctctgcctcccgggttcacaccattctcctgcctcagcctcccgagtagctgggactacaggcacctgccaccacgcccggctaatttttttgtattttttggtggagacggggtttcaccgtgttagccaggatggtctctatctcctgacctcgtgatccgcccgcctcggcctcccaaagtgctgggattacgggcgtgagccaccgcgcccggcctattctagcatatttcaactcttggtggcagaaacatctttcttaaatttcacccagaagtgaattacatgcccaccctttctttttccggatggatatgtggagagaacaattatagttctactttgctcttggctgtaggtatagttgttaataattagaaaacactcgaatggcaggttgccaattagagaggggagtataaagatacacagaacccgggcaattcaaatttgggacaatcgcctttaaagacattgagagttcactaaggttgctgatgaatcctgtcacttgtatcagtcaaaaggataatttgtaaatagcctgtagagaatcaaaggccagaatatactctcttttctgacaagcagaaaacacattatatgggctaattttccctgcatttttatcttaaaaaaaggagatgggtttctaattctgcaagcaaatatatattttttctaaatgtgagctatttcgaaaaacctaaaaccactcatcctagagcaagaacagggctaggttgagtgtccaagagaagactgtcacaggacctggcacattagtgagaaaggtgacattactccaggggaacttaatgatgccatttatttcttgatgctctgaggtacagcccccatttagacagattactctgagaattttgtaagatatccaatgagatacaatcatctttattggtggcactgtaaaggcaagtatgagagattttggcaagatcatctttttttagagacacatttatcatattcctttttaccttctttattaagtaggtactaatactatttctgattcactgctctctactccaaggattgcactaataggaaaattttcataaagcttttggctaagaactcctgctattgacctatgcccctttgtgtctaggttgatccagaagatacttcagcataaaaataaattccaacaaaatttagtttcaaattataaaagttgatatttctgctttatttgtccaaaagaggttctaaaatgaaattttctcaatttcaggtccattaaaaagtctgaatcttataaatatgcatagcttttataatacttataacttagatattaagaaaaatcaagatgtacattattaaagaaataacatttccattgttttcctttctcagaagtgggataaacaagcactgtaaactgaaataagcaatgcattctcagttccctcccaaaagaaaatactggtgtgcctgacttaccatttcagaaagtccagaaaacgctgcaaactaggcaggcagtcaagtgcaatggcaatgaataaccttataaaatttccagactttaagactgtcagtctggaagactacactatcttttagcacaaggtacttttggagattactctagggatcttagagaataattatacttaagtcctgccagggcctttttttttttttttttttttttttttttttactgtagtcaatagtacttccattgtactccttacatgacattatgttacagaagaaaatgttttataacaatgtcatttgagtgcttcagttgttacctctccttgaatacatatgaaagaataattacctttgtagtaaaggacattctagttatacatctatactttattggtttcttcatgtttttctcttcagaagtagaaacttaatgaaaatattgcgtaagtagagagcagtttatgacagtatttctttctaaataaattaaagattttattatatcttgaaatatatcacatatgtaaaatattaagtataatgtttgtgatcattttgaaacacagacttttaaactttaataaattatatccaagtaacattttaaatttgttatctaacttctactgttaacatctgaaaaaaattagaattggcagacatgcaagatgatgttgactttgcagccagaaaatgtggaaaggcctcaattagtatccctgattcacacttacaaatgggtgtttcagtgctgtgcagtttgataaggtagttaaggccatagtttgggagacagataggcatggattccagtcctggctcaggcatttctacttacgctattcgggcatgtcagtttttctttctaaggctcatttccctgtgtgtccatgaggaaataatgtgtttccttggtagaaagatggttgtgagggttcagtgcaatcatgcatatgcatagtaagtattccatatatctcaatatcatgatttatttcttgctacacaaacttacagtctactcactacctttgatgtaaagctgtcccactgtccttctgtgctttttctagaggttgagctcttccttcatttctggaatagttactgatttcaccagtaatttgccttttagatccgttgttacaggtgcctttttgaatctgactgctcaaaagctttgtccattttgtgttgctataaaggcatacatgaggctgagtaatttatgaagaaaggttttggtgctcatggtcctgcagactgtacaagaagcacggtgccaacatctgcttggcttctggtgagggcctcaggctgcttctacttatggtggaaggcaaaggggagctgactatgcagagatcacatggggagagaggaaacacatgggggcaggtgggtgatatgccaggctatttttaacaaacacttccctgggaactagtagggtgagaattcagttgccccaagggaggacattaagctattcataaggaatccgtccccatgaccaaaacacctcccactaggccccacctccaatattggggtcaaatttcaacttgaagttggaggagacaaacatccaaactatagcagaagcctttttttgttttttaaagctttagctttacctgccatatataatagttcaagcataaaattcaatgtcttttagcttttttagagttgtgctgccatcaccataatgaaactatgagacctttcaaagagaagacaggtgtaaacttgtgttatctttgattaggttatgatttattagatttgacaccaaaagcgcaagcaatgaaagagaaaaattcaagttagacttcaccaaaattaacagctgatatgcctttaggaagcatgtaaactcagaagccattcttacatgactggctcatggacatcattgatttgaccagaaatggacattaaaaccatgggaggctgatgcagtctctcatgtatgaatttgaaatagacacaagggaacaccatgaagagaatctctgtggaccttaacattttcaaattttagaaaacaacattttactatgtggaatggacagggagagtgtcaatgagaaaaacaggaggaggaggaaatgaagagagtttggcttaaaatgttaccactcaaaatgcctagcatgaattggggcaggtccatgaactgcttgttattggtctctacccaataagaagctggctccagaatgcagttcagttgacattttcttttgtaagaaagattttctcaattaaaaaaaatcaccgtgttgatttgcgtttgatagaatcttgtcatcagacaccagaattttgggtagcatttttcttttttttcttttatcttttttctttctttctttctttttttcttcttctttttttttttttttttttttttttttggagacaggatttctgtcgcccaggctggagtgcagtggtgcaatcttggctcactgcaacttctgcctccttgctttaagcgattcttatgtctcagcctcccaagtagctggaattatagatgcagggcaccacgcccagctaatttttctatttttagtagcgacagggtttcaccatgttgaccaggctggtcttgaactcctgatctcaggtgatccacccactttggcctcccaaattgggtagcatttttctagaatattgacactttaagctttcttatgatactcacttttttctttcctacactgttatgcccagtgggagaaggttgcttctcttaatagttctcagtaaatgctgattaaataaactgtagaagggtaaatagttaacaagattctgaatttggacttgtgatttttgaggcaaaaataataggttgaaagacatgttttttggatcaacaggcttgtatggaggtagacatttataatcttagtcatactagtgagtgatggacattttattactgttttgcaaaggtatggacaaagtcttaagatctatgtcttctacttttaggcatgtaggtaaaaatgtcagtaacaatgcagaaagccagtttatctatttaaaaaatgaatatattggaagccttgaatatgaggctgagtaatgcaagcttttcccaggagaactgtgacttcttgaggcccaaagctgcactccggaattataagtcctgagacatagtctataaacaataagtaaatatcagtcctatagctcagtgttcaccactgatgacttctcacacataagcaatatcatgttaagcagatagatactcatagtcatccaatagtttgcagtgggaaaatagtttgctaaaaagcaagatgtcatatgtgttgttatatttttcacacatgttgagaaattatctctgttgaagatttcttgagttaaccttggggcattagcctttgctgcaaggtttgaaaaactcaatttttcccattcagtgtgatctattacaagctattctgcttcctgaatttttgagagtattgctagttattttattctcagttacctaagaagggtcatatgagggaatgttttgattatcctaaattcgtttctatggataacttcatatctttgttcagatctgatttcttccatagtcacttaaacttgagaattctatcctatcttccacaaaagctatcattgaaatagctgtgctttccacttaaaaagtgaaaaggttaatggtatggagatgaaactggaatccaatcctcataaacagtactgtcttttccatttttatgttgcctttttggtcacctagaccatacacaagagattttatttttctttttgtctgattgcttctaaacagatttctattacatctccaaatttcagtttctctcccactgttcactctaggataaagtggagttcttactttatttcaatagaagctagaaataggtaccttaatgaggcaactcttgattttatttcagaacttggtaaaacttcggcttttcatttcaaaaacaaaagtaagcctctgtgcttgctgatctgtgttccgaagacttattctccctgtgcacccactatttctactagctagaagtaaggcagaattcccgtagagtaattgtgtttcagttgtatttcagacaccacagacatgaaagcttcacagaaaaggttgcttcttcctcagtggagctcatttggtaatagatgccaggtgcatgactgatgctggtttgaaatggaggacccagtaatggctatatcgcttggtgaaatcgcatgagctcaccagaattagaatatgcccgtaggagtaaacataacttctcatttttgaaaaattcgtaacttctcacaacttttgttgttctcattgctattgatattgttttaataatattcatctctatcagtgcccagcaagaaaatatatgcaacaaatattagttgaatgaatgttttaatccacacagtaagagccataggatataaatatacatgatcaatattccactgcagaaaccactggatatcttaaaacattataaagttacgtgcagaaaactattgctgtgctttatgattttaaaagtaaggtgtatttataataaaatatttaaaaatactgagaaattttagaaattttaaaatagtgacccaagaataatctttagttttagtattaatttttacatatgtacttaaaaattactgttgttgttattattattacatttgtaaaatgcaattggagtatattcattactttaaggtaggagtggggaagtggtttacttgagaaaaatgacatctagttttgtactttttctcacgctaagaagtacgtagaaacaagcaatcaactgaataactttagtgtttatttttaaaagtgatatatatcccaacaacttgtaacttattctttaaataacagaatttaagaaaatgaacaatattagataatattacataatagttatgtctcacttttagtatttttgtctttctacatgtatgaattttataattaactattacaatttttagacttccaaactaattttcatgattttggttatctgtattggggtacaatttacatacaataaaattcaccaattttacatataaaatttgattagttttggaaaatgtgtggtatttgcccctggttttctgaaaatagaattaaaaacccatcaaatcttttatcccccttcatctcacttccagtagagatatacttcttacattttatacttataatgtcttacctatagaaactgatagaatagggcctttcacaatactaattatttcatttggtgtttacagccaagcagttttgctcctcagaggatcttaactgggaactaaccctcatctgtaactatagtttctcacaccatcaaactttacttaaaatgtgccagagcctagttaaatgtcaaagaagaggcctggtagcctttgtttggaaatagaagacagtatctactttgaagttattgtttctaaccaatagcatcctcggattttaacatttttgttttattttgtttcagtctcactgacaaaatacctttcccattttgtgccttaatttccggtttgaatagcaatatcttagctcaatctttaaaaataagcactgtttttgtcccttttactgactgtttgctttttttaaaaaaagtccaaattagtttcaagatcaaacttctatgtatatttagaatctagccttgaatatttcctaatttatactgaattccatttatgtatcattcttggattagattttctaatctggccatgtttttttctttcagacctgttactagctcactcttttctattcaaatcttatttctcatcctggcctatttcccaagtgcaaagacagcggggcttcctgtgtcttagggctgcccagagctgatgcatatcactcaattacggtattataaataatatttttagaagtatataataaaaatattaccaccttaacagcttaaacctgaatttgtaatcaggttagaattaatccatgaaaaactttgtgatatagagcattgtgtttttctatgcacaactttgttgaaattctagcacttgggaaatgatgtctactcaagatttacattggctaattcttctcatactaattatttttactatgttgattatttattgttttatattggttgatggtttttcttgaatgctcaaataagcagccattcttgataactattgcttatctcagatgtgaagtatataataacattttattactggttttggttattggagtttattttaactaggattttactcttagttcagtttttaattcagtctgaaaggtattattaccaggtaggggagaggtcaaataacgaacattattttccaatcattctggcaatctttaaaaatgtggttccctgagtatgtatgtagtcatgtaccacgtaacagtgtttcggtcagtgatggactacatatatgacagtggttcaatgagattttattaccatacttttactgtacctttttacatttaggtacaaaagtacttaccaagtgttacaactgcctgtagtatttagtacagtaacattcacagatttgtggtctaggagcaataggctagactgtatggctcaggtgtgtaatatgctataccatctagatttgtgtaagtgtactctatgatgtttgcacaatgacaacatagcctaacgatggacttctcagagtgtatcccggtccttcagcaatatataactatacatatgatactgggttgtgatcatttcccagttacaaacaaattagctatcaattttctccataatatcaaactcttatgtgattctaagtaagtaattggcagaaaggagaattcacattagtttactgaaaaaaacacagtgtagttttatgaaatcttgcctgttagtgatataccctattcgcttttgttgacaaaatgcaaattacttctttaatattactcttctccataacattctgatttgtttaaccttgtcatgtttctgttaaaccagttcaacagaaagggctcatccacttataaataatgcattatctttcaaaagccctagtaattttttgcttataatctctgggtagcttcagtaagtcaaaacatgacttcatattctaacttgtcaaacttttaagcatcaagcaatttttcctgcacttttaattaactgcacaaaatattatctgtaatgaatagatatgttaacaagttatgttagaacaggacaagactagcttttggctcagtggggtagaaaaaagtaaatatattcttattgctgttgttaggaggtagctatgttagaatgttgctatggaagagagatgctactgaattgggtgcagtgaggggaaaacatgggagttaaaacatgtgggttatacacctatgtatctaggataccatgcagaagaggttggaattagactgatggttaatcaatgggataaagggatgtgttttcagtccttgtcagatgaatttctactttatcctctggattattggcccttattcttctttcccttagaacttatcattcttcaaaattacaattatttctgtaatcatatcaaattatcagcttcttaatgatgtttcttacccactgtgttttagcatctaagatatggatgtgtagctaattgtcataatagctaactagcattcattgcacgttcatataatgtccagctctttgttaagggctgaaagctcattatctattttaggccccacaacactctgaagttggtattcttaggaattctgtgaatgagaaagctaagacttcaggaatttagtgataaatttaggtaaaagttagagcaggcccaggacctacgtctctctacagtgacatacatgccctgaactgctactccctctctttctcacattacctaggcagcttttattgtgctttgttatctttaaaatagcgaattaacacttgctatttcataagcttaaagatgcattgcctgtaatattggaagctgatatgcagctcaccacatatccaaaggccggtaataatgaacgtaaaatagggaagaaaagacagagtatactgggatggatcattatctctacatgttgatttattttaaaagttcctttcagtgtatattaacaccttggaatgtgtgcaagttacaccggtgacctttctgcatagaactccaatgagagaaaaggcaacccattgttagatgaaatgcttttcatttcaagcatgtaagcagtaccacacttggtggattaaagatcgattgatctcagcaagcaaagaacgttgttaaattgttcagtcctcctttctggctttctctttttgctaagaatggaaaaagagaaggccttggtctctgttgtctcagattcttgtacctagggctataattgctgcagataaaacccaagaacaattgggttgtggttttcaagtttaattacattagagctgcttcttttgccctatagtcacatttgcaatttgtgattaacatattagtgggaagaaagtaatgatagattgtagttaatgaagcattttctctatctgttgtttcttcaatgcctctttcccgctacaggataagatatttatgttaatttttatgcatgctgtagttaggtttctatatattatgtagggaaagttctgcattagctctaataaataaagtgttcagttttaaatcatggtctttgctctactttatttatttgtatttactctttttcattactgcaggaggaaacagactcagtgttttatttttataataaaatactcttactctaagaaagagttattatgcatcctaatactggtatgcaaacatcattaaagtttacacagcaatggtttttaataacatttggagatattttggctgatgcagtttttgtgctaatattttggcttcaagataagaaaaactggatttaatccttgctagaatgctgggaaaaactgatgttatttgtaaatgaagatttaaaagcatttaactaagcttcgttttaagatatacatgtagagccacatctttttttttactttggaattttaaaatatgatttatcttcctttgtcaggtagactccagagtttaaagtgaaatatatatatgtaatatatatataatatatatatattacatatataatatatatatataatatatatatatataaaatatatacagaaggctgagaatcaaaccagtattgaagcattcttaccaatggcaactgggatagtgtttgagaatgagattgtggggtgtgtgtcgaggaaggaggtaagggtgtggattaaaagttttggaggtgagatgatagacaaggaagaaaattttattgttatatctttccttattgaaattgctcattagtttgaatccttccactgttgtctggactccccattaaaaaagaacatgatcactgagaaagtgtctaatttagatgtgcttttgatagcaaaataattataatagacaaatccttgaaaaggaatttccttgtcacatgacactgatatactacaaaacagttgtgccatggcagcttataatatttaagtttcctgattctaggtacaaagatctctctgtgaaagctggccaaatattcaagaatgtactgaaatattcaaaaggtgtacatttatgatctagaataattgataagagttgaataattggattgcttcactagggaaaggcagaaaatgtatgactgtagagttaacattcttgagattattaaggaaatgataaagataacaatggagaattcctttcagtgtactaaaagttagggaagcagtggaggcttttgctgaaatttgaaagagacaaatattgaggcaagtgaaaagtaatagtcgagtcatttgagatatgtgcattttactctgtcagttttattttatttttaattaattttttaaaatttcagtagcttgaggggtacaagtcgtgctgggttatgtggatgatcgtacagtggtcaagttttggcttttagtgtgcccaacaccaaaatagtgaacattgtattcaataggtaatttttcatccctcacctccctcctgaacttctttcctctgagtctctaatgttcattatactactatgtctgcctttgtgtacccatagcttagctcccatttataagtgagaatgtgcagtattggttttccattcttgagttacttcacttaggataatggcctccagttctactcaagttgcggcaaaagacattattccactcatttttatggctgagtagttttccataatgtttccgtggactcatttgtcagtacccaaatcagtagcattgctgtgcaccaacaatgaccaagctgataatcaaagaactcaatcccttttacaatcgctacaaaaataaactaaaatacctagggacatacttgaccaaggaggtgagggatctctacaagaagaactacaaaacactgatgaaagaaatcatagactattcctttccatggaatgataaggaaatggtatttccattttatttatccacttatctattgataggcacttggattggttctatatctttgcaattgtgaattaggctgtgataaaaatacacgtgcaagtgtctttttggtataatgactatttttcctttgggtagatatttggtagtgagattgctggatcaaatggtagttctacttttagttctttgagaaatctccatactgttttctatagatgtttcactaacttatatttccaccagcagtaggtaagtgttccctttctacgacatctgcaccaacatttactgttttttaatttaaattttttttttcataatgaccattctggctggagtaaggtggtatcttgttgtggttttaatttgcatttccctgatgattagtgatgttgaacattttttttctgtgtttcttggccatttgtataacttcttttgagaaatatctgttcatatgattatctcaatagactcttctgagtctattcaataaaattcaataaaatccaacatctctttatgataaaaaccctcaacctggtcaggcgtggtggctcacacctgtaatcccagcactttgggaggccagcgtgggtggatcacttgaggtcaggagtttgagactagcctggccaacatagtgaaacgctatctctatttaaaaaaatataaaaattagccaggcctggttgggggggagcctgtaatcccagctactcgggaggctgaggtaggagaattgcttggacccaggaaacgaggttgcagtgagctgagatcatgccactgcactccatccttagtgacaaagcaagactgcctcaaaacaaaaagaaaagaaaagaaagaaaagaaacaaacaaccgtcaaccaactaggtatagaagaaacatacctcaaagtaataaaaaccacatatgacaaaggcacagccaatataatactgaatggggaaaagttgaaagcattcctcttaagaactggactaagacaaggatgctctctttccctacttctattcaacacagtactggaagtcctagacagagcaatcatgcaagagaaggaaataaaggacatccatattggaaaagaggaaattaaactatctctgtttgccagtgatatgatcttgtacccagaaaaccctaaagattcccccaaaacactcccggatttgatcagtgaattcagtaaaggctcgggttacaaaatctatgtgaagaaatcagtagcgctgctatgatacaatgaccaaactgagaataaaatcaagaactcaaccgcttttataataactggaaaaaaatgaaatacctaggaatatgcttaactaaggaggtgaatgatctccacaaggaaaactacaaaacgctgatgaaagctgacacaaacaaatggacaaacagacaacacaaacaatgggaaaagcatcccatgctcatgcattggaagaatcaatattgtgaaaatggccatactgtccaaagcaatctactttggacaaagattcagtgtgattcttatcaaaatgccaatgccatttttcacagaattagaaaaaacaagcctaaaattcataagaaaccaaaaaaaaaaaaaaaaaaaggaagaaaagaaaagaaaaaagagcctaaatagccaaagcaattccaagaaaaagagcaaagctggaggcatcacattaactcatttccaattgtactaccagactatagtaaccaaaatagcatagtactggtataaaagtagacacgaagaccaatgaagcagaatagagaacccagacataaagccagatacttacaaccaattaattttcaacaaagcagacaaaaatatccactggggaaaggacaccctattcaatacttggttctgggaacactggatagccacaggtggaagaacaaaactagatccctatctctcaccatattcacattaacccaagatggattaaagacgtaaacctaagacctgaaaccttacaaattctagaataaaacctaggagaaacttttctggacattggcctaggcaaagaatttatgcctgagaccccaaaagcaaatgcaacaaaaataaacataagtaaatgggacctaattaactaaaaaacttctgcacagcaaaagaaataatcaaaagagtaaacagacaacctacagaatgggagaaaacgtttgcaaactatacatccaacaaaggactaatatctagaatctacaaggaattcaaacaaataaacaaggaaaagaggccaaataattttattaaaagcaggcaagtgatatgtaaattgtatttttaaaattataacaaaagagtgaaatctagtaaatgttatacctcttggtgtttaggagtgaagtgtactgaggtcttgaaatgcatccaaaattataagttagctttcaatgttcaagttaccttgaaatgtgtccaaaattaagatggattaattgacgggtggattaatggatgatagaggtatacatatgtggataaataggcaggtggatatgtgattaagcaaatataacaaaatattgattctagaatctaacactaggaacatggctgttcactgtgcacttctctcaactttcctttatatttgaacattttcataatgaaatgttctttaaaaaaggaaagctacctgagacaaggtgagaaaattcttaatgcctattcaggtaatactagctgaaaaattgaaaataaactttaagtggagatgattgtcttaatcccaaagtattgctgacacgggatttgttagcatgtctctaaggtgatgcaccatatattttggggaaaagcatttcattttccctgtaaatcatggtgcatcaataatcatgcacttgcaacaagattgtctctgacttctctaacactctagcattgcttatgaaggacattcttctatttggccaacaaagaatatttctgtcttatcttaaaacagagataaggcaaatcattttgacagtctctgaggcaaggtaatccctgctaatctactcatctttctacctcttacatacaaagaatgggctagagtttgtcatgggaccacaggaatcaggctttgtccctgagtttattatttttctgaggcagggtctcgctctgttgcccaggctggagtgcaatagtgtgatcacagctcactgcagcctcgacctcctagactcaagagcttctttcatctaagcctccagggtagctgggattacaggtatgtgccgccatgcctggccaattttttattttttgtagagacagagatctccctgtgtttcccaggctgatcttgagctcctgtgctcaagcaattctcctgccttgacctcccaaagtgctcagattactggtgtgagccatggcatcccacctctgcttcattctaacataccacttcttccctgtttcccggactaaatactcaaggtcattaatagaacattattaaatttgaagacataaaaattctaactttaagctttactaaccaacataacatattgaattttccccaccacaaatttccaatagctggtaaattaatggtgtgttttgtctttcatctttaaatattgaatgaagcacagttctgctagatactcatatcacaatacatgtcttcagaaacaatttatatgcccagtgtatcaatatttaatttatttacacatttttttcatcactacctttatttgaatgatggatgtgttgatgcctaagcccatttatcactaagaatgaaataactaccactgggaaacttttgggaattatatatccatgagcttttcagaactgatcttttgtgacgatggaatggtcactgaccagatccttattgtagactcattacttttgaacacattcatcaataccaaggctcgggtggctgctggatgtcacagatccatagcactgtgccaccacgtgctccctaaaaatctattacatggtttagactatgttttcccaagcttaaacctaggaaaattgattgcctttcccataagtttacataatcagagaaacccagaactggaaagtattttaagcattcattcaggtcaaacatttgtgttctaatagaactttcttaaaatatccaatacaggcaacagcaggtcttattctaaaatatttctggaaaaaaattattccatttagataatgccatgtatgtatccagtccttcactatgtgcagtggtaactagtctaattttaattactgctctttaagccagtattcacctaaacttcataggaatgaatcccttcagtaacatccttatagtagacttcatatatttgtaaagctacataactacatataaaaccaattatgttttttcctagtcatttttatttataatgcatagtctaaactcttttgattttattttagaacagcattatttaaactttcttgctaaatagtaccagagaagcctagaaactcaagaaaaactacttttgaaatattcttgggatctaaatttttgtctttaaaacatgccacataaccttttctcatgtctccatactgaatcaatgcttaccttaaaacaccatattttaacttatgcattagatagaacacttccacacatcaaatgttcaggtaaaatagattatctgtgaacagacttggaatttattctgctgcttgccaaatccttgccatgctgctgtttcctccaatgtggtatgtgtttaaatctggggagcatactctcagtacatcacaagtatagcctattattattgttgttgttattgatgatgctattggtttaccaaaaataatttcctgtgatactaagcacatggctatccaattgaaacacttaacttttactgaggatctgagcattgtcccatggcatattaggatgtgttactgctaaatacccttctgaagatggtgaccgaatccttgaaatgtgtctgttgtggcagtttgaaagacaagtgaacgccaaggtcaggctatcactcagtgaagccaactggctggctgcccacgtttctcataacatttcatttattttgatggattcaccaaggtatgagccctggcactcaggtttggggcacagaaactttgatgtttataagcacattaaatggttccatctctagggtacagattcacattaaccaagggcacaaagactagcaagtaagccacagtgccaaaggataaattgataaagaaaagaaaaatggccttgcagctggcaggatgcgggtcagtgcggtcaggcccttctgtccctgttggcaggtatttcagaaaagctaaatgaacatccagaagttgctgagtgagtgaacatgaaatcaggaaagaaaaaatcagttttatgattaaggtatttagtagtatgaaccgaatgtttccttatccattcatttcttcatagagactcacatatcatggaaatcagagtgggcaagagttgggagggcaatgatggtatttacaccttccaattgttgcacagcttctatagatgtattcagttaaccgtgacgtaggcagtgcctttctctgtagtctgggaacagttctttttcttatgattcaactctgagaaggcagtgctttctttttttcactattacaccatcatgtggtgtaggtgagcttctggaaagggaagaataaaagaaattatgttaactgttcagaaactgtgtgatttagtaacatagagcttcgttacagtaatgtaccctgtaagtggaaagacaggcagtatgggtattacgaaatgatttttttttaatggaagagaatgatggagaaagagacaaaggaaagttatgttagagtcataaaccctgcatgatcctgtaaaaattcatgcttgatccctgcagcctgaatcaacatggacatcagtaaatctctactcttgccgaagaaacaaactaaggctataaagaagtactttgtttttgatactcattgtcttccctgacagccaagtcaaaagatggagataaacaatgagcgattttctaacatgaaaaacaagacaagaaatatctttcttataaaggaatccactcagtctgttagtgtatatactttgccagtcattcctacctgattcaatgaatatttattgattaaagatctagtcttgtgaaagagacacttgaaactggacaaacagatgtagtttgttaagtgctaccagagggataagccaaatgccatgagcagactagggagggatgccttgggagcctcattgaatcattctgaagaagtttgaaaggcagtcatggtgtgggtgggcatgcatttaactagtaggttgacctaggagggaaatatgcttctgcttttagagattaatgaatgtatttatcaaatgtgtattgaaattctaatgcatatcaggcttcgttaacactatggatacactgagcaaaagaaatgagattcagctcacgtacacaagtaggtaaatttttgttttttgtttttgtttttttttggattagcttttgtaaatttacatctagaagtactggtattgttttgtactctctctttcttttgttttttgctttttggggggaaggggacttccaaaatggtattatgacttttcttctttgaaaaagagttcttaaatttatcttcaaaaatctcttgaaaactagaacaaaatgaaaaatgactaggactgcattgttaaccttatcaattgtgactatcaatatggaatccttacacctatgtagtttatgaaggcaaagcctacagttagtttgagacaactattaagcctgaccaaattctcagaatgcttttatgatgctaataagtatcactacaaaatgaattgatgtttctcatgcagccaaagtggcaatgattttacaggagggagaggcatgaggttggttatctcttcctggcagatgggctgtccctccccaacccctcctcccgacacagacacaggttggtaggattttttctacctacaggttggtaggattctctgggagaatgaaaatatttttaaaaagcaaaacaaaggaaaactcttaatttatatttaaattacccataatcgaatgattcacgcaaaatgaacttttagagcaaacgtcttttcaaattgtatgagggatggcttatttttaactaacggtactgacaggacattctggggactgctgcagatactggctgctctattcacaaagactagggggaagaaaaggctgtcttcagtaatgaatggaaacactgactggctttgaggcgagtaattgccttactcacccacacaaaaatttcagccagaaaagtcctcctttaagcagagcacaaatgatgtgaaatgcatacttgcacagatatagtataacttaccttgagtttatttaattattcctggtccatgggatttttgaaaaattgccagaatactacttttctgcagatataaataaaaggtccaaatgttgcttaacttcttttttcctgaattgcatagtatatatgtgttagaaatggctaataaccgtcacagagtagttgagaagttaaaacacacacaaattcttaatatttctaattaaaagcagcataggaatattgattactacagtggaaatgtaatgtgttctttctttcctttttaaatgcctatatggtacttattaacacttttaatggcaaaagcaataaaaataattaaaagcacatttagttcctgttctgcctcatttcattaatttctgcttttttttcttttggagaaaaagttgtaaaattgatgtcttagctgtagctgcctctttatgatattagatttctgtatgtaaagaaggtattagaaaaattttctcctgcactcaaggaatctttaaacttaaaataaaaagtgattataccttctattttcaaggcagaataaaaatgttttacaatgaatagaattcttgattttcaaagaagtttattacatttgattttgtcagagttaataagtgataataaataaatgtgtggaaaaataaacttttgaactagatcaaatgtgtttgtttctatttcagtattggctttgatgcctaagaaagcaaaatatttatctactgaaagagcttatgtctttgtggcccccagcttttcctctggtgagccttaggaaaaatggcacttgctctggaggcagggaggaaactccagatcagacccaggtttctggcttgggaggtggtggtggtggtgaaggaagtgcagttggttaagataaggagatgaggtgaattgccaaattttcacccagatgctcggcggcctctaaaggtcggtggtgttaccaggcgcaaattagtaatgctggctttgaacttaccttgaagctgcagtgccacttgttcttttcatgcagtcgtatttcgccaatggctttttactattttcttaacctatgtttggcatcttacctgactcctgggcaattacaacctttaaccactagaaaaggaagtacattaaacacaccttgttcatcttgaagagagagcaggggaatgggggtttcctcagcctgggatgactttcttctgcctttcagatctaagctctttctgacctggatcttatttaactgggaaacggccaggatagatttgatctttagcgtttctaacaaacatcatcagggatctctctttcctgaatcctatcacatttagcatcttgcaccacagtgctgagtatttttaaaaatataattttctcttttgttcttctgatgtttaatacattattcatcttcccaaatagattctcatttatctgggtgcaataagttcatctagagtccttccttacctactttccttcctttcttctttcatgcattccttcttccctccattagtaataggctgactctatactaagacttcaaaaatgtgcatgttctttaagagtttacagatgttctaaaactgactgtttcagaggaactactttccttgactcaataatagttaatcctcaagaacgattatgtatagtttttttaattcttcaactttgtgagatgtggttataaaacttaaattgatatagatgaaacagtttataaatagttttcacttgcattatttcttggaaagctcgtaaatactgtatgcaagtatcccctccattttctatgtgagcagcatgagcctgtattatatctacgaagtaaatgagtgggggtaggttttgtgacatgctggctgcatcagataatgctgcatggcataagctgggcacacactgctgttcctgttttatgcctaggaagatgaaagccttatcttaaatcataaaagtaattattaatgggcagcccaggtgggcagaccaggctgccaagtttactattttctatcgctctacaatgaatattccacattaggtatagattatctgttgtcaagagagttttatatcacactttgatataaaattaagtgtaaaaagctattgagaatcaatatttgacattctaaaagtaacttcaagatgataaagaataaatattatactaagcccaaaaatagtttctgggtttgttatattcatctgtttaataaatataagtggatgcgtggtgcaccaagaacttagcttggcattgaaaatgcaatgagaagtaactatgttctctactctccttgtggacaagagtctagtctgttaactagaaactacttctagatgattgggctgcaaatatgatccttctgctatgttttgcctagaactttaggcagaactttagttctaggcagaatgtagcagaagattatatatgcagcctgctcatcccctgaaatcaagcttaaagatgatggtctgccttgttagtaatccgtagaggcttatcaatcccagaaattttgggctattgttccagtctgtagatcactgacattcttttagtgctctttcaaccacaatttatagttcccaggatgggtcaacaactgtactcctgggatgtcttttctctctgtgtttgagatgcagatagctagttatccgccagtcctcacaatgctgaaatgcatccctcaagattaaagattctattcctaactttaaggaataaatctgagcttagtgcttcagtccaaatattttgtgaatacttagtatgtgctttactaggtgttatggatacagaaatgagtgtgaaatagtctctgacctggtagaactcaatttagacttaaacataatttggaaaataacacgtatggaggaagattcataagcctgatcatgtgtgttaggcataactagttaggcttataattatgcttaaatggattagatcaaccgtgtatgtaacagagctagtaaatagataattagatattaaaatgcaggtgtactgattccgaagccactaactcgtaatgcatctaccaaattcctctgagtgtaagattgttcattttagcagtttcagaactgtgtcactccaggacttaatctgtatggtaggggttctccaatttgagtgtgcacaggaatcatctggagagcttggtacaacaaagattgctcagtccttccctccccaggaactcactaggtctgagctggggatgaataatttgcatttatataaactcaggggtgaagctgaccatattttgagtagcactgaccttggggactgtttcccagacttcagcacatagtagagccatctggagagcctgttaaaagtggctgttaggacttccctggccctggagattcagaagggctgtgatggggctgaataatttttattttcaacaagctttcagatgatgctgatcctactggtccatggactgcactgagctaaggcattgtctaaataggtagacagaagtaacctactaagaaactcaattttgaaaaatatgaaggcttgatcaaaatatgtactctccttagcatggagtcctttcatcagagaaatgggaaaaagtaaaagtaggaaactaaatggcatgaatctcatgggcaattttaagaagcagtaggcactctaaatagcaactgactttgatatgtatggaggatgttttacatatattgggagaagattgtctgtctgaataatgtaactgtagaaagacccttagctttgtgtctatttagaggtcaatttcagtttctatccctctttttaaaaatatcttgtccgtgtattctgttcctaacattaacatataaggttgatagaaaatatggataatataaaaagtggtattgaatgatatcactagaaatagtgttcatgtaaagaaaagatatgggccagcaccaagttctgggcaactccacaattttgagaaattggaagagtggctggcaaataacaaacaggaaagtatggtgtcacaggagccaagaaaatgttctcgtgggaggcttcagcagtgaaaggattggaatgctgataagaaatactgtaagatgatggaagaattggctgtctaacttggctccatggagatcacgatatttctcattggaatgttttgctcaaccctaattgtccttctttgcagaatgaaagtcttgtgggaaaatagagattaaaatataactaattctgtctataaattatatagacatatataagaaatatataaattcaatctataaaatagaactaatgtgtttgtgtgcatgcaacatttttccgtgaaatatagttttgcttctgtatttttctgttcttattcatgccacacattattcattagcacagatttatattccattttgataactgatatccacagatattgttttcaaaattattattttatatgattatttttccatctaaattttaaaatcactttatcaattaagaaaaaagttttatttggattttcactggaattactttaaatttgcagattaatctaggaagaagggacatctttaccacattgaattttccttaacagggatttgaagattctctacatccttcaagtggtcctataaattctctaataacattttgtggttttccctctttgggcaataatactttctaaagacatttaatatattgttttgctattataaatgctgtttttatatgtttttattatagtactgttcattgacattaagtacatttgcgttgctgtgcaaccatcaccaccagccgtctctagaacttttttcatcttatcaaactgaaactgcataaccattaaaaagataacttcccattttttcctctcttcagcccctaacaactaccattctgccttctgtctctaagtatttgactactcgacgcacgtcgtttaagtggaatgatacagtatttgtccgtttgtgactggctttattccccttaacacagtgtttttaaagttcatctatgttgtagcaactgtcgggatttccttcattttcaaagctgcataatactcatacatacacacacaggcatacacacaacattttgttattcttttcatttaccaatgatcatctgggttgtttccaccttttggctattgtaaataatgcttctgtgaacagaggtgtacaaatatctgtttgcatcactgctttcaattgttttgggtatataaccagaagtggaattactattgattattaatgataatcctgttttactgttttgttagatatatcacaatatgaattcccagctacaattttggggtcattttaaatactctcagttttctcatgtaccattttcttgattttctttagtttgtcattacttttctttagctctcagagtgtatttaaggcagttgttttaaagtctttctctagtaaatctgaagccttgtttctttaaggttggtttccagagatttattttgatcttttgaaagggctggatttccctgtttctttatatgccttgtgatcttttgttgaaaattgggtgtctgaaaaatcagacacttcttccagtcactgtagactgtgtggaggaagatgttctctaaatagcccggtatgaaagtttaagattttctcaggcattttctaggtctgtgtcttccctgggcctgtgtgtgtggtgttctctcccaatttccccatagacggggctgcttttatttatttatttattttgaaggctgctttgaaatgttttattatccgtccctaagagtttcacccctgcttcttcgtgaaatcttggctgttcctctgtactactcttgccttaacaaacatcttgcccccagtttctgcatgtcagcatactcttgcagttttcacaaactatgttacccatcacagttttgcatggcttccaaactgagattcaaactatatattcattttcgtctgagagctccaattgaggcaagacagaaaccagtccctcaggcagcccacagacaggccagaactttgcaaaataagttccactgccctccttccttcctgagagaaaaatactggaaagtgggctacttttttttttttttttttttaactgcactcactgttccaaggtggcgcaagcacaagcaataatgccgtgaaatgtcctacctttttcactgtggctttttcttgatggggcattcacttggttggaaagcagtgaatttggctggttaccagagctcccaaaaagctgttttagtgagtcgctagtagtttacttgatgatcctgtggaggaatgaggacctggagctttctaatctgccatctttctgatatcaaatctgtttgtttgtattttgtcttttttagtagctttattgtagtttttaaccctaaatgtgtccagaatcacagttgcttagtcctgtcttagacctctaaatcgtgatgctaaaagtgtaaaactaacaccacacaatatattaaggatagctgtcatacttattttgtttctaatttactgttaattcatctaggagtgtgtatgagttcgttttgacattactataaataactatctgacactaggtaatttatgaagaaaagagtttaattgactcccagttccacaggcttaacaggaagtatgactggacggcctcagaaaacttaccatcatggtggaaggcaaaggggaagcaaatacatgttaccatggcggagcaggagagagagtgagtgaagggggaagtgccacacgcttttaaaccatcacgtcttgtgagaactcactcactatcatgagaagagcaagagggaaatctgccccccgtcatccaccaggccccttctccagttgatcccactaggccccttctccaccatgatattttggtagggccacaaatccaaaccatatccaagtgtgcaccaataatcgtaattattggggagtgataaatgtgaattgcaactcatataattgcgagttcttttataaacaaattaattgtaaaaaaacaaacccaagcttaggcaacatagcaagaccccatctctacacaaaatatatagaaaaaaagtagccaggtatagtggtacatttctgtggtcccagctacttgggaggctgaggtgggaggatcacatgagcccaggaggttgatactacagtgagccatgattgtgccagagcaggaccctatctcaaaaacaaaaacaagaaaaacaatcccggaacaaaataaataaaacaaacaaaaaagagcaacaaaagacacttgcttggcatttctaacaagcttccagctgatgttgatgcctttgtaccatagctcagattccagtatgatttagcatatttaaccttatgtaggtcaacagcataaacctataaagagtataattttgaaaaatgtgtaacttgtaataagttataaaaaaattactttactcagcatagagtcctctaatcatagaagaaggataaatgaggaaactgtgaatggcatgagagcaatgagcaattttaagaagcagtaggcggagtaagtattaagtgcaacttaaatataagaaataatctctatgattatattttctttattggtattcttaactgatgtcttgtaggaaaccatgactgtttctcctaatactagacaatagtccataatgtttgttatttatactaaactcttacattcaattgactaaagttgtctttagtataattacatttatttctttaaattgaatttgaattttctttttgtggtatttttttcagacatactattcagatgacacgaacttaataaaaatttagaatttttttctgccttcaatatgttataaaatattttaaatagtgcaaaagttatttgtttcttggaggcaaaaatcagattttgccttcttcttttggaaactccttgaaagttatctcagttccttttatgcttattaatctaatatagcttgtaaatgttgtcaattattttttccagaaggaaaagaaatgcacattttgtggacatttccaaatacctacatgtgtatttttatacacattctctacttttaaaaaaactcctctgattcctttttcattctagattttgtatagttacataatcccagcatatccagcaccttttttataggatgttgattgaatgtgcatagtgaatgttttatatcaatataagaaaattaataatttttttctttatttcccatagcaaaattttatgatttattcttttacctttattttttttaaccttgtattgtattattgcctagaaaattctttctcagactttatgctcactgggaacaggtcttattttaatttgtattcccagcttcatcttgtgtggtatcccaaaccttaacacactccagtacattttgttaaatggtaaatggtattatttaaggaaatttaaattgaatttctatatctcaaggcttttcaagccagagctggctaaacatttcttaggtgtgttgtaagagcatgtttctttaagatggagtttattccaggtatcttttaaagttttaactcttaaatgctgtttctttaatatcatgagacaatatagaaactcttaaaatattttaacttcctttaggatattttcggattattcagcataaatgtctttgaactatttcaaacctttccatatttgacattacttaccgttgaaaatataaacaccatcagtaaaataaaataactaaaagacagttcaaacttttgagctatttaacagaacgtgaactgatggaagaggagaccccattttttttttaattttgaggaactttattgaacttctttgagaaaacattaagattctatgtgaagatgtattgaagcaagtcaatatagggaagggataaaagaaagtgagtaaataagcttttgagtgattggtgtgattgggttaagaatgacgctaagaacgaacgtaaacagtgttcacactctagggctaaaaacccaagtacatcttttcacacggaaatacagatatttttaagaaccttccttgtgcttcttagaaagtagacaggtggttggagaaaatctatttttgttaaaacacacccacattcaatctagatgtataatttcaatatctcaatgatttttccttgtattttctctaaatgtcatgcttttcagactatttcaatatagatggattatatttcttttcagaatacatatggcagataaatacattgacgttttccaaaggaaagtacaaatggaatactatttcttaaaaaaacaaattttggtatcctttacttccttatgaagaaaagcaaatccgctggttaagattttttctttattttgccaaataaaatggtgtattacccttgcatttttcctacttattattcccagcatttttctccttgcacctaaacaaataaaaaatgaatttggacttagataaattatctttatagtggtaagccttgtctggtaaactaaactgttccctgaaggatgatgagtaatttgttgctggtagatgtaatgtaaatagttaggttacagactcagtttagtttggactatagcactaacgtgtctctaggcaatcacaatgtttaatatgatctgacgttgaacacaagcgtttcaactgatgcatccatccaccggggggctcatttacaaaagtagcaccatctatggatcatttaatgtttgcccctaagtttctagaccccctccttgtgatatcataatctaacatgcactttgttctgtgaccaaagcatccagatgaccatgttgcaagttcctaacatgttccttgtctaaggctgctgcccaggatcatacctgttctgttggtctggcatgtgcaattgattgctttcagatgttgggtggtagaaagccatcaaaaacaaagtcaatcaggatcactttcaccaccacttaattaactggctaattactttctaagcacctattaagagaacaagagattgttaactgacgtaaggaatctaaaattgtctaaggctgggtgtagtggcttatggttttaatcccagagctttgggagactgacacaggaggattgcttgaggccaggagtttgagatcagcctgggcaacatagaagacctcgtctttacaaaaaataattttaaaaaattaactgtgtgtgatggcactatgcctgtcatcctagctactcagaaggcataggcaggaagatgacttgagcccaggagtttgaggtttcagtgagctatgattgtgccatgggactccagcctgggtgacagagcaagaccctctctctaacaacatttttttaaattaaaaaaaaaataaaattttctaagatgtgattcttacattaaggagttaataactttaaacccaacagggatatgagggatctttatacatggttttaagcaacaccaacactaccattcaccatcatcattatgacgatgatgatgtcattcattcatgacataatgaatgatgagaaagagtacaagtatattgagggagaacattccaaacagttcacttagtgtaaactttcttatcatatacttaggtaagagttttttttatgagttattttattttaatccttccaacatttaaaaataattgtcattattattccagttgttcaggtaaaaattttgaggctcagaataatttagaagtgtgtttgcagtctcctagctctcaagtagcggagttggattcaaacttactggtacagtgtattttaggcacttttctttccagagaaaggaaagtcatatctggcttgcataactaggagaaattcccaagagaagagacatttgagcaggatgttgaatgactgacagtgtctataactggatgcatatgaaaggggttggatggaacagaattaggaatggaatggtgatgtgaaggttgaagcatctgaggcaaacgtaaggaaatggtaatcagagcagcatgaaatacaagattctttctcaaaagcagattgtgctggctggggaaacgggagcgtggatacagataattattcttctagactgacacatttgtgtttgattctttagccagtgtagggatgttaaagaactttggagaaaaaaagtaacgtaagtaacaccatgctttagaaatgtaatggtaatagaatataaggtggatggaaaggggagaattatattacattcattaagtcagcagttctcaaatagggacttgtatatgccttgagcattgatgagtcatttcagaggaaccacacattcttatgtgcatcactttatgaacagaaaaatatgtctcgctcaaatttgttttaccactttttaaatggtggacttccgtagccagctgtgacttggaaaatatacatttatttgcaaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggttaagtgtgatctttataatcagattttatgaactagaactccagctctcctacttattagtgataaaaggatatgttactaatctcttcaaatcccgttttcttatctgcaaatttgtgaagatgacactaatcttaccagattattttgaggattatgtgagattgcaaatctaaaatatttcaataccagacacataataatatatataagctattattactctttgttagactatgtctggtagacattacatggttttatcatattcacaaactgaaaaacacagtcaaaagtcatttctcaaatggtttgtcatgagttggagtgacagcatatcaagatcataatcagtaaatttcagtttataattttttcttgattctcttactgaattgaaaagtcagttataattgctacatttctattctttttcctgttcttacattgtgaaacaataatatgtgcttgcttctgttagagttaataaataggaaagtatttatggttcttggcccagatacccattcgctgttggttactgccctttttttcactgtctcagttcttgagatgagtatttcccaactttcagaccactgtaggttttgatttacagcagcagcctctctcgttctgtcactctaccttctgagtagccttgaagtagggcatcattatagagaatcagcaatcatcacagcacacacattctaacaaagaaactcacctagaaacttgcaggaacgttgcattccagataagggtttatggtcacaaggcaactattgactgtctttatatcacttctctaaagctgataatttgggggacccactgtattgatttacgtggaaaatatgaatgagaatcctaaagtgcaagaggaatagaagtgttggataataagcattatttgaaaaagaggtgtggagcaagtcatttaagaaaaagtggaattgatctctcctggatttggtttatcagaatgaaagactaacttagagcgatttatctgagaagggaaacaacaaacaacaaaatgcctcctatgcatggtttcttcttgtatttatttagagtctagttctttaaatctgccgggtttatggcacaattcaataccaaaataactatatgaatattgacatcaatgttttaatctgtgagtcacaggaactcatgtacaaatttattaaatgttttctattctgtttatatttgttgacaacaaagcggctctacggcttctggtgtgatttgtgcacatgtagtgagctggatatcttcatattttgtttcatttatcaccaaatctgttagctatttctaaataaagaggctgtattgagaaaggatgaaaagcagttgggaaatggagtaggaagaaaaaaatgagaagctcagtgttttataaactgtattgcaaaaaaagctgactttcatttcaaatcattgtggtctgtgctttgctttggtgaattatgcccacacatatctagtcaacacaggagagcacagatcattggaggaatgaatagctttaccacatgcatcgtgagagatgtacaagtttattttccccatcaaccatacctttttccaatatcatgcatgttgcccagcaagacagtgtcattaaccactggtatagaaggactcatttaatttagttaactaaatcctgttttttttttttttttttttttatgagtggtgggagaactgtttaaaaaagacctgtttggttaacaaatgtgcgctgctctgcagtgagggacattttgaatgattttcccatttctagtctttgccccatccagttagaaagtagcccgtagtgcttcaagaacatttacatttacatctttattgtaggttccattgtagcaagaatacatgtaaatggactcgctctatttcaataattattttgcagagtattttggctatcatcctggtgtttatagtcaatgcatttttacaccatctacattttggacagcaagcataaaacgctgctggtttatctcacagagagagcagattgtcccccaaaagatagccatttataatatgtgcacttttgaataattaaatgaactactgaagaggaaatggattctaatcagctttcaaactgtgattgtgccatgcactgaatcattcctttatgaatacatttctcttggagcatgaataattacaaaacttttttttctatctcggtaggaactgggaagtaacagccctccacagagaaactggaagggaattgctattgctctgctggtgattttagttgtatgctcactcatcactatgtcagtcatcctcttaaccccaggtaatctgtctttattcctctcttatgatggatggtattgtggatgataatttcgcattcaaatgccttaagagggtagcaatatgtggtatcttagggcacattagcatgggttggaatttggaaaaaaagcataatcagacattttgcaaatggcacagtaattctgcagttcaaatatcatgcaggatattttggggaagctgaaaatgtaaaatatgtaagttgagaatgccaaggagatttttggtctccattgccacttacagacttactatgtgttagtttgataaatgcagaagacatttgacttttattgtgggttgaagatgagggagtggcatctggaagtttctatatatagatgataacccaactgtatggaaatggaaagacaggatttgatggaaaaagatcagatcgaaagagagtgatctaagcctctaaatttggacacctatttcttgtgtcttcttttcctttctttcctaaagtttttacattctaagtttctaccctatctaaagaaactttgcaaattgcccctgcaatgatttttggactgtgttcttcagattaaagagtttaatactaatatggaaattatcattgtgcttctttctggggactatttcaatacccaggagattcattactctttagtaggtactaataaggaaggcagagataaagggatcacttttaaactccttcagttgtcttccagatacatttagcagttgctgcaacccacccacccaactgtttttctcaaagaccaaacacccacatatgacacagtgttatgaaaaatagtcatttctgggataggattgaatgaatccaaaaatcaactgatatttttaaattatagcctgttgttgaatgctatttatttccacttcaggtttgtcttagttttgttattttatgagccccttaaacacattgaacttatttcctgatgtacaaaatatgattaacaataactgtttttcagagtcatttagtcaaataattttggtgactaattatacaaatggcagtatcaattgttccagtgagacacttcgtgagatataccatctttgaaaaatactgacattgaaataaataaactgccaaaaatgcagtttttagatgttagttaacatgtggagaggttgagaaagaaattaagggagctactagggaggaaggaggagagaaaggtaattggaaaggaagaaagaaaaaattccctggtaaaagttggcttatccggcattctccccaggaaccttttcttaactgcctcatttgtacatctgcagtacaatgtcattgagcaatgtgatggctctaagttgctgcataatgccaagaatcattgttacaggaagatgagtttcagcatggtgtttcacttaaacacaagaagtttaacataattataaaaaaagaatgagtcgacattgctgccttctattgatggctattagccagatggaggtattcatgtcataatccctgtgtatttctcttgaactctttttctttcatcctggttctagcatccttggcccagtgattcactttctcaggttttcttgttactcattgaggccatagtgatattttggtgtccttgagagtttgatacaacaaagaccacatagagtgaggcactcactaagttaaacttctgctcaacccttttcaatttttcccagtataaaaccacagtgatgaaccataattgagttcattttgtcctgcacttattcatttgttaaagcaagaacaagcgtgacatacctgagtttgagttctgcctctgtaatacagtagttttgtgcaatttggcaagttatttaaccttctctctcactttactcatctgcatgatgggtataatatttagttccaacattgcagtgttattatggaggtaaaatgagataatgtagttcaagagtttatttagcatgctgcctagcactgctgctgctattcctttgatgattgctattattcagtacttattgaccaccagaaaccatgacaagcagtgttatataaagaatgttccccagaaaaggtataaaacctctcaggaatatacatcttctgtgacttcaattttagttatgacaaacggaaagggacaaaatatttaacctgaagttagtctcctggggtcaaattattcatgcattcattcatcccataggtaattgtggagttctcaccacattctaggtgctgttgtagttggccctgcactttcgctattttataactttcacctccaatcccgttacacaaatacaaacatttagaaaatacacatatttagaacaccacagccccccaactcagacttaatttcatatgatattaatcatataaatagaagtggcatttatttatttatttatgttttgttttaagatggggtctcgctctgttgctcaggctggactgcagtggtgcaatcatggctcactgcagtcttgaacttccgggctcaagcgatcctcccacctcagcctcctgagtagctgggaccaccatgcctggttatgttttattcttattgttatagagatagggtctctctgtgttgtccaggctggtctcgaactcctggtctcaagcagttctcttgcctaggcctcccaaagtgctgggattacaatcataagccaccacacccagcccacaattattatttagatttacagtttaccaagtgcatttcacatactacatgttcaaatgtctttggatttcactattattattggtagggacattataaaataaaaaagaaaataataatgctggagtggaaaaggtattgctgtaggaagcagacaccctactttatacagagagtgttctatactttctgcaaactcaatgccctcaagtgcctagaagattatgtaaattgatcaagtgggcaagtataacaactagtggttagaaatttgagttgtgacccagcaaaatggcagtgtagtcgcatggcctttacggtgggctcaacccaaacatgtcagagtaatacataaggccagaagactaatagtttgcagctcaagacttgagtcttcagcctggaagaacttttagaaatgatctagtcttgcctctctcatcagacaggaagaatatctgagtttgtttaacttttggggtgagaacaagaatatccatcaaggccatgtacactcttgattttgcgtgtgtctggctgtgtacgtctgtggtcagcctgcagtgctccaactgcaccaagcctttctcttctaaccctcaggcttgagttctctcagctgtgctaaaacagagccataaagaaaacctccagctggaaattaaacatgcagcatcatccctctgatcttccctctgtccaccaatatgttctcaaggcctagctttctaagtaaaaccagtcaagcaggtggaaactttcaaccaagtagaggaatctatgtcaggaggggaagcttctgactgtggaaattcagcaagacactgggccttttaggacaaggcctgcctctagaacaactcttccaataagagtggcagtcaggccggacgcgatggctcacacctataatcccagcactttgggaggccgaggtgggaggatcacgaggtctggagttcgagaccatcctggccaacatggtgaaaccccatatctactaaaaatacaaaaaatgagccgggcatggtggcatgcacctgtagtcccagctactcgggaggctgaggcaggagaattgcttgaacctgggagtcagaggttgcagtgagcccagatcgcaccactgcacttcagcctggtgacagaacgagactctgtctcaaaaaataaaaaagagtggcagtcataaattcatatagcttttataattatacaaccctgggctagtcactaacttctatggcttcagtgtttcattgaagaaaaggacatctttggtttgctaaaatgtgaggtgatctcttgaagtgtattataactctaatgtctattatctaatatattaataacagctaccaatgataataatgccttgtttagtgacaaatatagcaacagatgaaatatggtgggctctttcactaagatttttctaccatgaaaatatatttagtgggttggttttgaagatgaaagcatacaaaaagttatttagtcaaagaaatgttttagaaactgttttactcaaaatagcacacaatttgcaggtaagtctaaggaatgcaagcctataaccagagaaacacatgttcactgtaatttcggtttgattgcaaattttattacagaagtagtttgacacatgtgccttaatttctaaaattatcagactcttccttgccttgtgaagagaagtcctaactatttttgaagaataggctattcaagcatttcattttataagtatttctgaaaggaacaaattattcattccatttttttaattacagggtggacttattcagatgcattgatgaagcctacattattttttctattgagtttgtttaaagagaaggagtttacccacgtttattttgagaatatgttaactataagatcaataattatactctacaaatatatgagtgtacattaatgcttaaagttgtagaaatcagtctagtaaaggtatgcatctactttgcaatcttgtttttacatttaatatgtagaatgagaaggaatatacttgggagaacattttgtgcagaatagaattaccaattttggcctgttttaagaacaaaggtgcatattttatgagtcagaatgcagttgatacaggatagtcatcaggctctttaatccatctgccatactgaaatagccacctgcgaactgtgtatactccacagttcttcagcaacaatggcctgttgccctttgactgtgtctgtaatcggtcaatgccgagacagagtcatcacactgattatctgtcatgctgactaagggtaaaacgggaaagcaccaaaatgtggtcttcattgttagctctagctcctgtttcttttggaaacttcccaattaccctctgttacaatagtgggattcattcctttagtacactttttaggtgtgcacagtagatggtctttgcaggtttatcagaatataaacataaccaagcattgatgtgggaatcatgagagctctgcttgatctcagttaaacaagaatttaatggtaatttttcagttccgcaatagagatgtctttattttcacttctagaagtgtctctaagattaagaattttaaactaatttcataggccatgttgggtaataacttacccaggtcgatactgccacagtgatgttgatgattagataagtctttaatatcagatatgtgttacatccatgaagctatgctcaattagttcatttgagtcaaaacagagaattaagcaagtgaaggaaactagagaaacataggcagccctattcagaaaaatcaacaaaagaaaccaaaaactagaagacagcatttaaggtattatgccttttttacatcaacctaaatgtacagtgcacacaatcaactcatttaaccctcataacacaccagtttaaaggaagtagagcagttttctacataacacagctagggccaatagatttggatgacttcagcagctagtttgtggagaaagtatagtagatagagtgactaaattgaccttggtattcgactgacttggattcatctcctagccttactatgtgcccacaaatatgatgttgaggtaaagaatcctctctgttcctattgttaagacaacagattaaaaaaaaaagatttgaccctttgaaagagggctttaaaaatattcatatgcctgcacacacacacatgcacacacacacatacacacacacacacacacatacatctatatgtaaaactcatttcctagaaagcatttaataaaattaaggactttattggactgatgacagctgatctgttattgttatgcaaaaactcaaagtgaattcattctagttactattttgctctaacaaaatgacagctcctggttatagttagttaaaatgttatgttgtactatattgcagacaatatcttggcatctgtaatttattaggtgtcatttaagcacctgacctgtgttttaaaatgtcaaagcaatgattaaactatccccattatgcattatgaggggaaaataatgttttaccagatttttagatttgtactacttgtaaacatcggcatcaatcaagatgcaaattgtttattttgttgaattaaagcaggagatgtgctgtattgataggcatagtctaatgtgtctctgcttgtttttttcaacaacagcacagattgaacatggatttccatgtagcattacccaggcataatcaggctgcagagaaaacaatgacagattctaacagtttccccctggataatatggattgttgttgcttttttaaatagatttatctctgatgttgaataaaaaataatttcctctggcattaacggaataaaaacagttacttttttgtctttcctttatagtttcatttctatatttaagccatatgtgattcccttagttactctcataatgttagagtgtccagtcagataaatgatgaatttggtttacattataatgtgtttagttttacaagagtcagaagagaacctataaacatttatgtatatctttttcttgccagatgttgtactaagtgctttacatgtactattttttctcacatcactaatattgcatagatactattcatttatttacattctagagtattcatctgagtcttacaagttgaagtaaattgactaatttcacacaactagaaggcagagatgctcgatcactctctcaggcacttttagctttgacatgtgtcataatccttgtaatataagttaagacatattcttgtgcccatggatgataggggcaaaaaaatattttagaaaaataaatttcccctttattctttcctatgatttttgtaattagtaaactaattctatgtatttctaaaagggaaggcatagcagagaaagaattcagctgaggattgaggtgtaaaaatttggacaaggggcagaaagggaggcagtgacagaagtgggaagttgaaaatcgtaagtgtaaattctgtatgtatttttatttctggtttcataatttttcagaacttcaaatacccatgataaaatataagttcatattttccatcctaaaccacattatataaaattgtgtgtcattatacaactttaatagtttgtcatatattttatttcttcttcctaatagaaatttgatttagaaatgtgatattctggcctctaatgtatgattagatagtctggtctctgagaagtcaggtttccataaaagcgagagttatggtggggtttggtggctcatgcctgtaatcccagcacttgaggaggccaaggcaggaggatcacttgagcctaggaattcaaaaccatcctgggccacatagtgagaccccatcgcaactaaaagttttttaaaacaattagccaggtttgttggcacatgctactcaggaggcaggaggattgcttgagacggagaagttgaggctgtagtgagccatgatcatgccactgcactccaagctgggcaagagagcatgactctgtccaaaacagtcttccatctagttccaaaacatattcatcaccccaaaaggaaactctacccattaagcagttgctcctcatatcccacctcagttgctcctcatatcccacctccctcatcccctggcaatcaccaatctacttctgttctctgaagatctactttttctagatatttcacataaatggaatcaaataacatgtgacctttagtgtctaacatctttcactttgcatgttttagaagttcatccaccaagtcacttgtaacagtgcttcatccctttttatggctcatagcaatccattgtatgcatattccagagattgtgctactgtgaacctgtgtgtatttgtttgagtccatgtttttagtgtttggggttatatacctaggaatggaattgctagatcctatggtaatttctgtgtttaaatgtctgaagaactatttgccacagcagctgaaccatcttacattcccaacagaaatattcatgtgttccagtttctccaaattcttagaaacacttgttcttttcttttttttttttttcaattatgggcattcaagagatatgaagtagtatctcatttggttttaatttgcatttccctaataattaactatgttgactgagtatcttcttatgtgtctattggccatttatatatcttctttaaagatagatctatttaagcctgttgcccattttaagggacttgctggttttactgatagtgagttgtaggagttctttattccggatattaatctcttgtcagaaacatattttcatatactttcttctataatgtaggttgtctctttactttcataatagtttcatttggtgcacaaagttcttcattcacctgttctttcattgcttgtgcttctgatgtcttatttaagaatacactgctgaatccaaggtcacaaagatctgtcttttgttttttttaaatgagtttatggttttagtttatctacatgggtcattgattcattttgagttaattttttttatggtgtgagttagggagtctagctttaatttttgcatgtgaataaccatttcacccagcaccatttattgaagagaccattctttcccaattattattgtgtgaaccttccttggttatagatatatgagttatttctgggcttataattttacttcattcatctctatatctgtcctcatgctggtactgcattgtttggattactgcacctttgtggaatgtttgaaatctggaagtgtgactattacactttaaaaatatatatattgctttgctatgaagagcccatcacagttccatataaatttgagaattagcttttttatttctgcaagaaagccagttgggattttaatagtaattgcattgagtctgtatttgctttaggtaatattaccatcttagaaatattagtgttccaactcataaatatggaatgtcttttcattctggaaataatttaaataaaacaaaaatcaacattttgtagtttatagtgtaaaagtttttcatacttggttaaattcatttctatttagtttattcttctttatgatactgtaaatagaaccttaatattcttttctgattaatcattgttggtatacagaaacatgactgattgtttagtgttgaccttgtactcttcaactttgttgaaatcatctattagctttagtagcttattgtagattatctgagattttctatgtatgaggatcatgtcatgtgtgaacagagatagttttacttcttcatgtccaaattgaccatcttttagttctttttcttgtctagttactctggctagaatttccagtacaatgctggataacaatggtaaaagtggatattctcgtcttattccatcataggtggaaagctttcagtctttattcattgagtagtcttagcttgtttagataaagattctttacattgttgagggagattctttttatttctagctcttaaaatatttttataaggagtgttggatattgtcaaatagattttatcaataaattgagatgatcatttgttttcctcccttttctactatatgttgtattacattgattttcttttgctgagccactcttatattcctggaataaaacccacttgttcatgatgtataagcctcttcatatgctgaagaactcagttttctaatatacctgaaggatttttacatctgtatttataagagatattgatctgttggtttcttttcttgtgctatctttgtctaggtttcatatcaaaataatttttaacctcacagaatgagatagtaatcttttcttgtacagttttgggaggagtttgagaaagatgagtgttaattcttctaaatgttagaattcacaagtgaagtcatctggttctagcctttctattgttaggaaggtttttgattaatgattttgtaacttactcattataggtctgttcaggcattttatttcttcttgaataagtttggtagtttgcgtttttctagaaacttgtttacatcatataatgtcttagttcatttgtgctgctatagcaaaataccacagactgggtaatataaacaatagtaaattatttctcacagttctgcaagctggagaaagtccaagatcaaggttctagcaggactggtgtctggagagggctgctctctgcttccaagatgatacctttttgctgcactctccagagggaaggaacactgcattctcacatggcagaaggaacagaaggaaaagacagccttcccttcaatcctaagctcttttataagggtattaatttcattcgtaatggtagggccctaataattacctctcaaagttcacacttctcagtattattgctttggggattaaatttcaatatgaatttggaaggggaatataatcattcaaaccatagcatataatttgtatctgtattgtttgatacatatatgtttattattttgtctctttaatgaccatttttcaatatatagtatcacttcttctcataacaatttttgacttaaagtctaatttttctgatatgaggataacaaattctgctctttcttgattacagtttgcaaagaatatatttttccatcatttaccctcaatgcattgcatctttagaaagcaagtaagtgaattttaaaaatccattctgccattttcagccttttgaatggagaattacatttatttacatttaatttcttaaaatgaagtaattgtttcattgttccatttgttttctgtttgtccttttacgtgttttttttctttaagtccttcaatgctgctttcttttgtgtttatttttataatgcccttctttgatctcttctcatttcctctcgaattttttttcttatggttatgttggtcatcataattcatattttaaatttagaacaatttagtttgaactaattttatcttatgttcaatcacatacacaaactgtttttatacagcttcacccttacaatattgtttttgtcacaaattacatctatatatattgtgtgaccattaatctagatttataattattattatacatttttcttttaaatcatgttaatataagaaatataaagatgagtcacaagccaaatatacaataagactgccttttctatctacctagggagttatcattactagagttttttgtttcttcatatagcttcaaattattgcctatatttttccacttcatgctgaagcctccctttgacatttttggagggcagttctacttattgcaaactccctcagctttcctcagcttttgtttatcagggaatatcttggtttctccttcatttgagtgacgattttgctatatatagaatttttggttgaaagctctgttcttggctgggagcagtggttcacacctgtaatcccagcactttgggaggctgaggtgggaggatcacctgaggccaggagtttgagaccagcctggccaacatggcaaaaccctgtctctgctaaaaatacaaaaaattagctgggtctggtggtgggagcctgtaatccccgctccttgggagcctgaggcaggagaatcacttgaacccaggaggcagaggctgcagtgagctaaggtggcgccattgcactccagcctgggcaacaagagtgaaaccccatctcaaaagaaagaaagaaaggaagctcttttctttaaaaatgttgttccaccttcttcttgtctctatatttattgctgagaaatctcctgttaaacttattgagaatcccttatatatatcaagagggttttctttcgctgcttgcaggatcctatctttgttcttatcttctgcgtattttattataatgtgtctcagaatgcatttttttagtgttttttttttttttttgagtttgttgaacttcttgaacatatagttctatgtcctttgccaaatttggcaagttgttggccgtcatttgtttaaatactctttctgcccttttcctctctctcctcttgtgatttccattattttatgttgctatgtttgatgatgttttaaatgtgtcttaggctttgctcattttccttcactcttttttctttctgctttctgtaccagtaattttaattgatctattattattttcactggttctttcttctgcctgctcaaatctgctgttttattcttctactgagtttgtatgtaagttcttagacttttaagctccagaatttctgtgcatgtatgtgtttaatactttttatctctttattgatattttctacttttttcatacattgttattctggtttcctttagctctttattcatgatttccttcagctctgtgagcatatttaacacaattgatttaaagtcattctctattgagtaaaatgtctgtgcctccccagcagcagtttctattaacatctgtgaatggacttcactttcttatttctttggatgctttacaatttctgattgaaaagtgtacatcttgaatattacagtttggaactcttataatcaaatttttcttccttttctgggtgggcttttgtttcttgctgtaggctgtagctatttgtgttttctttggtagaatattttaaactatttttgaaaaatcactattattcaccatgtatgttctctgaagtctctgttctttaggttgtggttagctagggttttctgtttgattattctgttttccttaatattttggtttagaaatgttttcttgaatattaggaggcaaatgtggctatggtggggtgtggaggctaggagaaataaaaaacagagagggtaaaataccttttcaggttagctctgtgtttcacacttaaacacttagccagcccatttacaactctaccttaatctttacttcctgcctctcttattgtgataaacctggattccttattatagttgaagcccagcataaggtttatatctttaccacctacactgctttctactttattatatgattcataatagtttctattacaaactaagttctcaataaatgcaggcatgcattgtaatattgcaggtttagtttcagaacactgcagttaaacaactattccaataaagcaaatcatacaatttttttttggtttcccactgcatgtaaaagttatgtttatcgtatttgtagtttattaagtgtgcaatcgcattatgtattataaaaatgaacagaccttaaataaaaactgctttattgttaaaaaaattctatttgatgatctgagccttctgcaaatcataatctttttgtcagtagagggtctttccttgatgttgatgactgctaactgaacaagctagtggttgctgaaggtgggtgtggctgtgacagtttcttaaaataagagagaaataaagtttgccacattaactggcaattcctttcacaaaattttatccatagcatgcactgctgtttgagagcattttctccacaatagaccttctttcaaaatgggagtttcttctctcaaatcctacttctttatcaactaagtttatgtaatattcgaaatcctttgttgtcacgtcaacagtgtttacagcatgttagctaggagtagattccatgtcaagaaactgctcctttcacttcatccataagaaaaaactcctcgttcattcaagatttattttgagattgcagcagttcagtttcatcttcatgttccacttttaattcaaattctcttgctgcccctaccacatctgcagttatttcctgcactgaagtcttgaacctctcaaagttatcagtactgattggaatcagcttcttccaaactcctgttaatgttgatattttgaccttttcacataaatcacaaatgttcttaatggcatctagaaatgtgaattatttccagaagatttttaattcactttgcccagacccttcagaagaatcagtatctatggcagccttatcaaatgtaattcttaattaccaacattggaaaatcaaaattactccttgatccgtaggctgcagaatggatgttgtgttagcaggcatgaaaacaaccattaatattgatgtacatcttcatcagggctcttgggtaaccaggtgtattgtcaatgagcagtgatattttaaaaggaatatttttatgagtagtaagtctcagtagtggatttaaaatatttagtaaaccatgctgtatccaagtgttgtcagccaggctttgttgtttcatttataaagcacaagctgagtagctttagcatgattcttaagggccctagggttctgaggatagtaaatgagccttggcttccacagaatgtcaccagctgcattagcccctaataggagagtcagcctctcctttgaagctttgaaaccaggcattgacttttcctctctagctatgaaagtcctagatagatcaagaccatgctggctaacacgatgagaatccatctctactaaaaatacaaaaattaggcaggcagggtgtcacgtgcctatagtcccagctactcgggaggctgaggcaggagaatcacttgaacccaggaggtggaggttgcagtgagctgagatcgcaccattacactccagcctgggtgacagagcgacactccgtctcaaaaaaaggaaagttctagatagtatcttcttacaataaaaagctgttttgtctacattgaaaatctctcgtttagcatagccaccttcatcaacgatcctagctacatcttcttgataactggctgtagtttctacatgagcacttgctgcttcaccttgcactttgatattatggaaatagggtctttccttaaacctcatgaaccaatctctcttagtttcaaagttttcttctgtagccttctcatctctctcagccttcacagaattgaagagagttaggaccttactctagattaggctttggcttaagggaaaggtgtggctagtttgatcttctatccagaacacaaaaactttctttatatcaacaataagcctgttttgtttttctatcatttgtatgttcaatagattagcacttttaatttcccataagaactttttgtggctaactgttgggagcaagaggcttagctttcagcctacctaagcttttgatgtgccttcttcactaagcttaattgtttttagttttggatttaaagtgacagacatttgactcttcctttcgctggaatacttagaggctactgttgccctaatttcaatattgttatgtcttagggaataagggggcctgaagagagagagagagacaggggatcaattggttgatgtcacggttagaacacgcacaacattatgctcttatgtggtcatggttcatggctccccaagacaactacaatagtggcatcaaagatccctgatcacagatcaccgtaacagatataataataataaagtatgaaaaattgtgagaattaccgaagtttgacacagagacatgaagtgactgcatgctatcagaaaaatggtgtcaataggcttgcttgacaacaggctaccacaacccttcaagttgtaaaaaacaatgtctgcaaagtgtaattgagcaaagcacaataaaatgagtatgcttgtattgaccagtgacaaatttatctggttatccactcttgcaataaaaatgtcagagaattgtttagtgaaagttcttgataatgaagtaataaataataatacaatagaataaggttattaaagctgatgatattaccaaatagaaaagaaagtcaacatcttttgagacttgaataatatttattataaccctggcagtttgaaatgtggaaaaacataaacttgtaaaatacacaataaagtacgttcagtagaacttagtgtagtgtactctaacaaagtattgaggacccaaaaatgctttggggcatttgaattgcatatatcaccatttgtaaaattagacattgcaaataaattctgagatttcaaataaaatgtgtattaatttatttaagatgacaataataaaacaattacatataaatataaataacaaaatgaaaagttatgtttttcaaaacaaaaaaagcaaaataaatggtattgtttcacatttttacaaatgtatttaatgtctaactcagaggaagatggcagaattctcatatgtgctcctctgttaattcttttgcaatacattgttttggttgagatatatgcagaaattctgacctgataaagacacatagtcagaaatagaatatgtatgttaatagctatttcagatcattgtagaggttttttgctgttacttcctgaaaactagataagtgctagatgcttgaaggttaattgcagtgtaaaatctgaataatattttaatactctgctacattaaagtccattggtccatcttacatgttgaaagactcttacccacgtctacttctgtaatatgaattggtcatttgtaaaatattagttcattgagttatgcaggtcttccaaatgtcagtggagtttattatacagccatgcacattataatggcttttaggtcaatgacagacttcatatatattggtggtcccatttgattgtaattcagctgtaaagttcttatcccctagtgacacaaccgtagtaaggtcatagtagcatgattcattactctggtgtttttggtgatgctggcataagtaaacctactgtgttgcctgtcctgtaaaattatatcacatagaattacatatggtacataataataatgataatagactactacattactggattatgtatttaatatactacacttttattattttacagtgcattccttctacctattaaaacataagttaactgtataatagcctcacgaatgttcttcaggaggtattccagaagaaggcatggttatcataggagattttagccccatgcaccttatttaccctgaagaccttctagtggaataggatatgaaggtggaagacagtgatattgatgatactgaccctgtgtaggcctaggctaatatgtgtgtgtttatgtctttgttttttaaaaataaaaatattaaaatagacaaaggttatgcaataaggacataaagaaggaaaatatttgtgttcagttgtcaaatgtgtttttaagctaagtgttattagaaaagtgtcaatgatgaaaaacattgataaagtaaagcagttacaggaagctaaggttaatctactactaaagaaagaaaattttttaatgcatttaatgtagactgtgcagtgcttataaagtctacagtagtgtgcagtaatatcttaggcattcatattcactcaccactcacttactgactcactcagagtaacttccaatcctacaagctccattcttgaagtgccctatccaggtgtaccattctttttatcatttataatgttttttaactatatattttctatgtttagatacacaaatagttaccattatgtttcaattgcctgtgattttcagtgcactaacaggcagtacaggtttgcagcctagcagtaataggctgtatcttatagcatagatatgcagtagactttagcatctgggtttgtgtaagtacattctacgatgtctgcacaaccatgaagttgcctaatagcacattcctcagaacatatccctgtcatttagtgacatgtgattgtacagttgttaaaaatcatgatgaatttcactaatgatttcactaggaaaagctcactagagaattattgagaaatgatcaaacttaagatggagaatatcagttttctaaaattcattttcttgcttgaaggggctcgaatttttttgtttgtaacaaatacagccaattgtggattttgtgaagaaaaagtttacttcattttgaagaaaaacacctgtcagacacttaaatctgaataattgtagtttgttactcattccttccagtaaaaataatgttctatgagaaacaatgtggtgagtttagctcataactcaagcaactgaccatatgcttttccatgagataaccatcatatttcgtatgcactggtgttattttattttttgacatactgcaccacacagatattcaaaagatgttgagagtcaagatgtagtacaattaatattttttactacttctgaactgaaactgggtttatttttaaattgaggctatatggccataaagaatataatgacaattgtttgatgtcacagtgtcgacttatgaaagggtgcctggagttttatcaaccattgcttttgtatcacaagtgaaaatttcaacccattgacaaggacaataatgtcttcgtgttattatgaatacagttttgatttctgtgacccctgtcttcctgaagtccacaaccatacaccagaaacctctggtgtaggctaataaagacatgcaataaaaatttggtcatggtaatgtgatagaatcaagcaacatatgtgaaggaggaacttaaatatgactttatagagccataacactttagggtaaaaggaggacatcatttcagggtgtatgtgtgtacacatgtgtatgtatcacagtgtgtaaatgctcttctccaaatgtggaaagcttacatacatttctcatatttagattctttactcatattcaggagatgttaatttgaaaaaggtctcagaaagaggtttgagaatcattagcattttgaatgattgactaatttggctaattagaactatgagtaaatcctaaagctcttgacttatgtaatcaatggatgataagtttgaggtaaaatttaataatagtccttcagaacctaaaggtacatttcttatttgatgagcactttgagtcactgccaaaaatgaaagagcctagtataagatataccagaaatttgagaatcctaagagatgcaagctagtttgcagctcatcatgtgtgtttgtatgggttttgtgtgtgtgcaagcatgtatgtgtagagcttcaaataaaattctatacaaagaatcaaacatgccaaagcagcatttttctggttgaagaggtctaatcacataacctctgtccttccctcatctcttctctatcctgaaagagttcactagagtccttagaacactgctggatatagtgtgatttagtccaactcttggtctttgcaaatgcaaaaaatgatgcataaataaatggagtgatctaaccaaagagatacctgctagtgaagggttgaattaggactaaaatatgaccttctaactctgatcactgtttgtgaagcatcattgcccatccccttttgagaacagagaagcagaggttagatttattacagtatgctgggcactgcagggaaggtgaaggcattgtaggtggtaaacttcttgcagattatgcttttgttttatgtactcagtatgaatatcctaaatattatttctatatttgttgaaaaaagagcagagttttgtgagaaaacagaaagaagcagataataaattatatttcatttgtcagctgtcctcctcattctatttaatacaggcacagtttggtcttaatttagttacttaccctatgttgagttttaaaaatgtatttataattaaaatatggctttctgtatgaaagtcccattttggaaatatactcagataggaaagaacattcattggatgattgtctgacccaggaaacaaattaaattaaggagtatgtattattaggctttgtaagatacagggataatctgagtcaaaagtagttcttgctttctttattttttattttatttaagttctagggtacatgtgcaaaacgtgcgggtttgttacatatgtatacatgtgccatgttggtgtgctgcacccattaactcatcatttacattaggtatatctcctaatgctatccctccccgctccccctacccaatgacaggccctggtgtgtgatgttccccttcctgtgtccaagcgttttcattgttcaattcccacctatgagtgagaacatgaggtgtttggttttttgtctttgcgacagtttgctgagaatgatggtttccagcttcttccatgtccctacaaaggatatgaactcatccttttttatggctgcatagtattccatggtgtatatgtaccacattttcttaatccagtctatcattgatggacatttgggttggttccaagtctttgctattgtgaatagtgctgcagtaaacatatgtgtgcattgtgtctttatagcagcatgatttataatcctttgggtatgtacccagtaatgggatcactgggtcaaatggtatttctagttctagatccttgaggaatcgccacactgtctgccataatggttgaactagtttgcagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcttttgcccactttttgttgggtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattgtggcttttgttgccattgcttttggtgttttagacatgaagtccttgcccatgcctatgtactgaatggtattgcctaggttttcttctagggtttttatggttttaactctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtactatttctgttctgttccattggtctatatctctgttttggtacgagtaccatgctgttttggttactgtagccttgtagtatagtttgaagtctggtagcatgatgcctccagctttgttcttttggcttaggattgtcttggcaatgtgggctcttttttggttccatatgaactttaaggtagttttttccaattctgtgaagaaagtcattggtaacttgatggggatggcattgaatctataaattaccttgggcagtatggccattttcacgatattgattcttcctatccatgggcatggaacgttcttccatttttttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttatttgtgtataagaatgcttgtgatttttgcacactgattttatatcctgagattttgctgaagttgcttatcagcttaaggagattttgggctgagacgatggggttttctaaatatacaatgatgtcatctgcaaacaaggacaatttgacttcctcttttcctaactgaataccctttatttcttcctcctgcctgattgccctggccagaacttccagcactatgttgaataggagtggtgaaagggggcatccccgtcttgtgccagttttcaaagggaatgctcccagtttttgcccattcagtatgatattggctgtgggtttgtcatagatagctcttattattttgagatatgtcccatcaataccgaatttattgagagtttttagcctgaagtgctgttgaattttgtcaaaggccttttctgcatctattgagataatcatatggtttttgtctttggttctatttatatgatggattatgtttgttgatttgcatatgttgaaccagtcttgcatcctagggatgaagcccacttgatcatggtggataagctttttgatgtgctgctggattcggtttgccagtattttattgaggatttttgcatcaatgttcatcagggatattggtctaaaattctcttttttttgttgtgtctctgccaggctttggtatcaggatgatgctggcctcataaagtgagttagggaggattctctctttttctgttgattggaatagtttcagagggaatggtaccagcttctccttgtacgtctggtagaattcagctgtgaatccatctggtcctggactttttttggttggtaagctattgattattgcctcaatttcagagcctcttattggtctattcagagattcaacttcttcctggtttagtcttgggagggtgtgtgtgtccaggaatttatccatttcttctagattttctagtttatttgcatagaggtgtttatagtattctctgatggtagtttgtatttctgtgggatcagtggtaatatcccctttatcattttttattgtgcgtattttattcttctctctttacttctttattagttttgctagtggtctatcaattttgttgatcttttcgaaaaaccagctcctggattcattgactttttgaagggttttttatatctctgtctccttcagttctgctctgatcttagttatttcttgccgtctgctagcttttgaatgtgtttgcttttgcttctctagttcttttaattgtgttgttagggtgtctattttagatctttccttctttctcttgtgggcatttagtgctatgaatttcccgctacacactgctttaaatgtgtcccagagattctggtatgttgtgtgtttgttctcattggtttcaaagaacatctttatttctgccttcattttgttatgtacccagtagtcattcaggagcaggttgttcagtttccatgtagttgagcagttttgagtgagtttcttaatcctgagttccagtttgattgcgctgtggtctgagagacagttttttataatttctgttcttttacatttgctgaggagagcattccttccaagtatgtggtcaattttggaatcggtgtggtgtggtgctgaaaaaatgtatattctgttgatttgggtggagagttctgtagatgtctattaggtccacttggtgcagtgctgcgttcaattcctggatgtcctttttaactttctgtctcgttgatctgcctaatgttgacagtggggtgttaaagtttcccattaatattgtgtgggagtctaagtctctttgtagatctctaaggacttgctttatgaatctgggtgctcgtgtattgggtgcatatatatttaggattgttagcttttcttgttgaattgatccctttaccattacgtaatggccttctttgtctcttttgatctttgttggtttaaagtctgttttatcagacactaggattacaacccctgcctgtttttgttttccatttgcttggtagatcttcctccatcccttcattttgagcctatgtgtgtctctgcatgtgagatgcgtctcctgaatacagtacactgatgtgtcttgtctctttatccaatttgccagtctgtgtcttttaattggagcatttggcccatttacatttaaggttaatattgttatgtgtgaatttgatcctgtcagtatgatgttagctggttattttgctcgttagttgatgcagtgtcttcctagcatcaatggtctttacaatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttggtttggctggatataaaattctgggttgaaaattcttttctttaggaatgttgaatattggcccccactctcttctggcttatagggtttctgccgagagatccgctgttagtctgatgggcttccctttgtggataacccgacctttctctctggctgcccttaacattttttccttcacttcaactttggtgtatctgacaattatgtgtcttagagttgctcttctcaaggtgagaagagaagtttagggaaaaaaagagtaaaaagaaacaaagaaagcctccaagaaatatgggactatgtgaaaagatcaaatctacctctgattggtgtacttgaaagtgacggggcgaatggaaccaagttggaaaacactctgcaggatattatccgggagaacttccccaacctagcaaggcaggctaacattcaaattcaggaaatacagagaatgccacacagatactcctcaggaagagcaactccaaaagtaattctaattagtagaatttatcaggaatggaccagagcagactctgttttttttttttttttaagaaacctagctatttctgcaacaagagattagaaagagtaagaaaaggcaaaagaaagatatatagaaggaaatccctagtatgccaagaagagcaaaggtgattccctggaactgtaaaacagatgtagtgtatttgacttttcctttttggcttttgcttgaatggatgaattaggcttcacaatactaagtgacaagctattaggttttcttcattaaagagcttgaactatagattattatttttccaatttatattttggaacttataaagtcaacatagttaaatacacttctgaaaagagacttttctgtgaattttacattttactatatttttccaataactataaagaagcaacttcatattgtgtttctaaaagtaaatctgagaatacacgtagaaacatttcggttgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaaaataagaatagaatttatatttcatatgttaagtactaaaacaaaatcttaggatctgctgacaagttagagaatgcacaaagcaatggcagatattttgaaaaatctagaatttaatcttgactattgtgatttgcattctgtagtttcatctagctgtgcaaggaggggtagaagtgatgttatttcaatcagctagtcaataatatttaaaatggaaatgcattagaagactatcccatatgacactaaccatggaaaatgaagaatacgattaagagtaaatatttaaactacagccctgggaatggagatggtggtactgggaaaacccagctaagggagaatcacgtgagtagaaaggaaaatagcttgttcttcttgtgggaaattttaaataactacttgattagatttttctttctatttctgttttaataggaaattattttgaataggatttaaattaaggaaatatttctaaacctctgatatcaagaataaactagataaaactaacacaattattttcagcaaagaggaaccaagaacttaaagtcataaattagcttttcttcagttgaatgctgaagaactttctttttttttcatctaagattatgcagccaactcatttcaaaggccatttaaaagcaagattggatttttggaagaaagaacagaaatacccatagcagtctatgatcttaaaggaccaaatagagcacagaaaagaacatggcgtgaattattcaatttcagttctgttgccacattcatattgtcaaagctgaactttttacttaagattctacaataccttgtaactatttaaccaataaggattctgtttccaggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggagaacaacctatgagaggtgaatattaaattttagcaatattttctttacattagggactaagtattgattttagaatttctttctctaaagattaataaaaattaataatattttgaaagagtgtctcaaaatgatttacaatctaatatttttttctgagccaccttctcgttgttcagtgtgagtgattgagatgaatgattgatatccaggtttctctgtttgctaggtaaaaataaagagaaaattatttaaatgtatcaaatagtaagatttctctaggtgattctccctgggtctgattctaacataaattaagttcctgctaaattacgttgcaatgtgagtaataaatgtttgttgatgactgagttccgttgtaactataaattgcctgtaacaatgagcagagggtaagcttggaatttaagacatattgtagacaagtgtcttgaagaaagcaaaaaaaaaaaaaaaattcctacattttagtgaatgctgtgacatttctctctttgagaaaagaggatatgctattatcttcctgggcaagttgaggcagaatgggatgctaataagctccagaggggcttacactaaggagttggatttcagttggaagaagggttctagtggctaaaaggcaataagaatattcctaaaatatttttgtaagattgtatattgtcttgtgaaaagatgctattaatacattattaaagagaaaaggaaagaaaacttatttttgggagatagtatagcttaatgaagaaaacctaaagtcagagagatgcaggttcaagtttcagctctgccaattactagttacgtggtctttgtcaacattgccgagcctgtttctctgtgaaatgaggatactaatacccagtagggtttgggggacattcagaaaagagaggattggttgcaaggaatgaacatcccgaaggattacaatgagacagggggaggctgctcataaaaaaaaaaaaaaaaaaaaaaaaaagatagaggatagaagttagccttggaggctattaaaagagaagcttaattattcattatgtgtataaggaaggagtctttattctaggaatgaaaaattcaagagacctcagggtaggcagctaaggaaaatttaaggaaaggaacaaagaaagcaacacagaagaagaaaaaaacaaagaaatgaatgaagtatatagttttctcagtattgaataaagccaaatacattaattattaaattacataatatctccttctcattattgtttaaacagaagatttatttatagttatttgaattgctttgaagggttggttttagaataagttccaggggcaattggagttaaaaaatattattaaaattattaaactattccagagcacagaaaataaacacaacttcaaaaatattgaataaatgtattaatgtgccaagtgatcaatataatacagaatggaaaacaaaggactgtgtaactttgtctgttaacctagatgtaaacatttaaataaaagtttaacatattaatctaatagtataaaaataagaattcaacgtgcttggttggattttgttacagacatatcgggtggttgtaaacaggagattgtatttatgtaatttttatatcaatgtgttaaaggagaaaaatatgtttatataaaagagtctggaaagaaataatgattatttcataatggaaaaaaagcaatgtcactgacactatgatcattcaacatttttttaaaataaattaattttttttagttttagggattaggcctcactctcttgcccaggctggagtgaagtggcgcagtggcacagtcatagctcactctaaccttgaactaactcctcaactcaaatgatcctcctgcctcagcctcccaagcagctgggattatagacatgagccaccttgcccagctcagtatcatttttcacattcaagctaatgaaataattcaatagaattaaacaaatgcttttcaaaaatgaagttggaacaattagtcatccatagacacaaaacaaaataaaccagcagacaaacaaaacttcatattaagcctcatgccatgtgtgaagatatacaaaaagtaactcaaaatagagcagggaggaatatgtgaaataaaactataacattttttaggaaaaagccataggagaaagtttcaagaccaagaaataggtgaaacattgttagacttgacagcaaaagcacgattcataaaaggaaaaattgattacctggatctcataaatattgatacctttttctccacaaaacattttctaaagagggtgaaaagacaacttacagactggagggaaatatttgaaattcacgtatctgacaaagcatttgtatttagaatagacgaagaactcatcaaatgcagcattaaacaaacacaccaacgaaataattcagttagaaagtgggcgaatgacatgaacagatatttcactgaagactatatgggaatcataaataagcacattaaatgatgttcaacctcattagctactagagaaatgcaaattaaaccacaaggggatatcactacacgtatataagaatagccatttttttttaatgacatcaaatgctgccgaagatgcagagaaactggatcatttatacattgctggtgagaatgtaaaatggtaaaactactgtaaaaaagcatatggaatttttaaataaaactgtaatgtgtttacatttgacccagcaactgcatatttgggcatttatcttggagaaaagaaaatgtatgtttgtacaaaaatctataaaaaaatgtttatagtaactttatttttaatatccccaaaccagaaataacaataactcaaatgttcttcaatgagtgaagagttaaagaatggtctctcaataccctggaatattactcagccatcaaaagtgatagattatttatacattcaacaacttgaatggatctcaagggaattattctgagtgataaaagccagtccaaaagcttaggtatggtatgattgtgattatatagcattcttaaaattacaaaattttaaaaatggagaacagagtagtggttggttgccaagggattgggtgggggactgttaatgaaagagtggcagaagagatcctagtgatggaactgttcttgactgtggtgctggtcacctgtgatgcagttgcgtagaactaaacacgcaagaatgcacgtgaataaatgaatacatgtaaaactgcagaaatctgagtaaggttgatggagtatatcaatgtcagtttcttttcgtgatattattatgcaggatgttacttgtcattgagagaaactgaatgaagagtacacagactttctctgtaatatttcttgcaacttcatatgaatcttcaattacctgggaagcaaatgcatacatagtataattagttgcttaaaatttggaaaagaaagaaaaaagtaatatgtttacagatgctataatttaatatgtagaaaataaaaactcataattgaaatgtttaagaaaatgtgatatggtgtaatcattaatcttataggtataaaaataatttagaatgggaatgggaaatattctgttcacaataccaaactatatatactttgcactaaattcaattggaagggcaaaggacttatataaaaaatcaaagataaaatagtattaatgtacataaaatgaggatggaatatttctgaatgaaaagccttaatattgtgaaatgtttaaaattttccagttttcactgttgtgtgtatgtatattatatatagtgttattttaataaaatttctatttgagttgtaatatgattttaaagctcacatgaaagataccatgtttgaaaattaccaaattattattttaaaatttatttgaaaataagattatttggtgtggtggacttacagccttttttttaagttaacatcttcctaaaaaatgtaaatgaaatatgtggaactcattaggaacaaactaaatgtttttggaagacaaacagatgcatgcatataaaagaaatttatatatataatacagttaattttttaaatttaatagataaggatcatttaagtttgttagcataatttctctcactgaaataagtacatgcctacctcccacctttacctatgtaaatttattgtatcaaataagtcaatgtttatcaaatatagatgataaaatataattctctaaaaattgaagggatctgattagacaaaataatggtaaatttacgtgatagggaaatttaaaaattttgaaacttatctatatcaaacttttgttttattgagatacctcatagaataaatatatttctgaaaccctaataaaattagctcatctgattaaaatcccatacttttatgatggaagctgaattctggaattaagatattttttcgcttgtgaaacaaaaagcacttatccttttatcgcaaatgttcttcctccttctcctgcccctagtattcccttcctctgccttttgaaacatgtaatacccagggtttttttaatagtttttttttataatagattatttttcagagaaattttatattcacagcaaaattgagtgaaaggtacaggaatttcccatattctcttccccctgacccccctgtgcctgatacagaccatgcatagcttccccaattatcaacatcccgcaccagagtggcacaattgctatcactcatgaacctatattgacacatcattgtcacccaaggtctgtttggattcactttccagtggattgtgttgtatgggtttggacaagtaaataaagacatgtatccaccattgtagaatcatatggaataacttcaccaccctacaaattctctatgttcacctgctcattccttccctcgcaattcctagcaaccactgctatttttactgtctctatagttttgctttttcaaaatgtcatgtagttgagattatatactatgtagccttttcttactggcttctttcacttcataatatgcatttaagtttcctccatatcttttcatggcttgatagctcattttttttagcacagaataataactcattaaaaaaatgtatctatttagccattcacctattgaaggacatcttggttgcttccaaattttggcaattattaataaagctgctataaatgtttgtgtgtaggtttttctgtgttaatatgttttcacctccttttgggtaaatacaaaggagcctgattactggattgtatgataataatttgtttagttttataagaaaatgccagattattttccaaagtgactgtaccattttgcattcttacccaggaattagtgagagttggtcattttatgtttaagtgaggccttctctgattttttctgtgagacatttcctttcttcaaactcattaagcactctctatccttatactgacatctattatgtatgtatgtgtgtgtgtgtgtaatttgttttttgagacaaggtctcaccctgtcacccaggctggagtatagtggtgcagtggtgcgatctcagctcactgcagcctccgcctcctgtgttcaagcagttctcccacctcagcctcgcaagtagctgggacctcagacatgcaccaccactctaggctcattttttgttttatatattttggttgacacggagtttcaccatgttggctaggctggcctggagctcctgtcctcaagtgatccacccgccttggcctcgcaaagtgctgggattacaggcatgccccactgcgcctggcctgacatctattatatgttttgttaagcatgtgcaaacccctcagggcaggacagagatatgtctcctatcctttacagtactgcacttgttgccttgaaattttttaatgaaactagaaaatttgtgaatgaattaagaaattctggtgtgtcagactgccaggcaaatgatcaaatatatatcatcacctaacagcatttcgttttgcaaagctctatacaattacaatgtcttatgctaaaattataatcaaacaatactcactatttttactataattttttttccattttttcttggcagttattttatgggttaaatgcatgattgatttatgtgaaagggaattgcatttgacgttattgactctttgccccagccttttcagctagaaaaaagcaaagctcttgctgtaacaagtgctgaaccttttcagaataaaatctaatgaggttagtatatatccttgacattttattttcaaccgaagtgaaggtcatagctgaaaggtcacaaagatgaatttatacagcaaataaacaatgttattattttgcaaagaaaatgcaatattcctgtctttagcctcttgcatgtaaaagggtgtttgtaatgctgattttagtattcaagtcctgttatcttttcatttcttatattttggaatgtagaaagaggaatacacctagcttatctataaaagactagtatgaaatgtgtgtattatcattaatattctagtattttattatttgaactttacatttaagtcaaatctactttgtatttgttgggtactaatttttttggtggaagtaggtaattactctatttccttggtaaacttctttctgacttgagagtttagtcatacataagtccctcaagtctaccatctttggtttttaacaacaaaactgtacatttccaatgaaagaatatatcaacataagtttggaaaataaggggctgaattatagttaaatggtagaaaatctgcctttttgggcacaatgtacaacaggaattcttaactgctttcatattatattactaatacgtaacatgggattgctctattaaatttgtaccagatcaagacaattttaatagtaaaaatagtttcatttatttaaaaagtcattaaacaaagttcaaatgccaaaaaccatgtcaaaatggtcactttatattgttatgtagttaatatattttagagcaaatattccaaattttgtaatttgctccttttaaaaaacaagcataagataggcatctaacctagaatttcctttattttagatgaactcacaaattcgtcagaaaccagattgtctttggaagacctctttaggaaagactttgtgcttcacgatccagaggctcggtggatcaatggtaagtgtatacctttttaaacattgtattcattttgagttctgtataattaaaattttaaaaaatgagatgtgtaagctgggcgcaatggcttatgcctgtcatcccagcaccttgggaggccaaggcaggagaatcgcttgaacctgggaggcggacgtcgcagtgagccgagatcgcaccactgcactccaacctgggtgacagagcgagactccatctcaaaaaaaaaaaaaaaaaaaaaagatatgtgtagttaatatttaattgaaagtgtacttcaaagattacatgggtattatttaaattaaaaccttggttcttgtgagagaaaatcaattcctaagatagggcgtcaataaattatttggcaaacattgggttgacagttttgtatctgctgctctctcatgatcattagttacatgactttaaggatgtattacatctctagcacatcactagataatttttcttagtttggcagtgtacattttgggagctagtacgtagaaatgttaagtgcttcagatttgacaatatgattggtttttgttattctctgtggcttttctttttaagcttaagtgttacaagctagtgagactctatgcaaaattgaaatgacttggaaatatatggcactttgttgtttttttttctggcctggcaaataggactccttaggttctcttaagtcaatctctgacataaaaataagaaaataaaaccactgagtggcttcataggttttgctttgtctttatggaagatcataagggcataatgtgttggtgaaaaggaaatcagttttttaatcctttgaatgttctaatttgaccaaccatacgaatcattatggttggatagctgttaatctttacccttcactttatttgggcataatatctttgctaattttcaaggcatagagtgtattatttgtataatagatgaaaggagctttgccttttcatataataaagatcatcatacttacagtccattccttcctctctcttactctacttaagtgtatttatgctggtgaattaaactttaatttatggaagctatataaagagaatgtaatttaacccatgagggcaaaggccaaatcacgtgtgtttacttgacactgatatgtctcctggagatctgcaggcactcgagattggttttttgaataaatgaatgaatgattttaattgatgtgcagtctcattttcacataaacttaaattttaattgaaatcaattggaagataagtgtgtattgtgatgatattacggataaagaacacaaggtagcgtttttcttaatgaatctgtatatttttattttgaattgtttataaatttgaggctagtcatatttttgcctttgtactgtgattatttcacatatacactataatgagtgctatgactaaagaaggctaataaaaaagatatattatcacaaaaaattgtccaaatacacaaatctctcataaataattcttctaatgtgtgattataattatgacaatcacctgtttactctttagcaaatattttctattgagagaaatgacaaaatgaaagttgctaggtttttttaaacagtagtattatgagttgttagatttgaaatgctgaataatcttgttttattcaccatgtttttggacaaattatagacattttgtagtctttgactttggaaaacatgaaaaattatgggtctcatctcccttctcaggttagcttggactatttagaggcatttactcctgtgtataactgactctgtgatattgaagctccgaaggacaggacagatatttaagtagtgaactgcatgctaaattaaaacatatttcaatatgtaggacacagattctactcttatacttcataggttaccaaaataatatatttggagtttatcatttttcaagtaatttctttattaatcattggttaaatttgatcctaagaaggcatctgggacaaagctgcagtgttattataatgttctaagtaatacctaaatatataatttttataaagaatttgacataaagacaactctttaaattggaataaacagaacctaagctctgaaagaatgcagtctttataaataccattgaaggaactgtctcaatgcctgtaaattgtgtgcactgagttactttttaagtatagaaatggatttgtgcttttatccaacccagatctttctggcaagtgctagatacttggcctatttacgtattcctcacatagcctggaaattcaatgggaaatatatgagtaggatgtgtaaccttggcctcattatcaacagttatatctaaatgtaacctgtgagctttttctttattctcaagtgatatctcaacaggttttctttgtacataagtcacttgaaggagttcgagctcagcttatttggaagcatcatttaattcttggaggtcatcatagaagtgcttaatgcattattggtcaaggggaaggagggagtctagacggccctgacatgtgtaggttatagtgaggcgatgccattcattatgcttggtctcaaaaaatatgtctgagaatatcattgcagtcttggatgggtgcccctgttcatggttagcttaacaacggccttaccccaagtctgctcatatctttgaaatctacatttttatagcatcttcattctagcaatgtcaccttgaaatttgaaaacccatcttatttaaaattattcattctatccacacacatttgataatcaattaatcaccaaagaaagatctaacattgagtgccttctattgagactctgtgatcgatgctttatgtacatatttcacaggactgcatatgacattaaagttaaccccagaaaactgaggcttaactcagaaacttatccgaacacacacctaataaaaggcagaggctgctttactcattatgcttaagtataaaacttgacctctttcattgtttgactctgatgtgtcatcctcatatctaacatatttatcaagcacctcactgacaatctcattttaacagacctcattgctgtcgtagggtggaaaggtatgaaagccttcctcacccatcataaaggtcacagccaacactgctgtaacaaaagaccagttaaaaagagaaaagcataacaaatttatttaatgaaagttttatgtcacttggaagactttagaaatgaagaatcaaaggcctagggaaaactgtccatttgtatgcttaggttaaataaagtacggacagtgtattgaagtgtgactggacaaaaagggtatactctaatgataataaaatgagggagaaacccagcaaagcttacctgttcagatccttcttggcctccctgtgtagcatttcatcctgccagatataaggcagaactcccccggaaatagggtcttatgatctattatctgaaaggtaggtcagtgcatttccttgtgacagctcctacacagaaaagcagaggaaggttaaaatatttttaaatcttatggtttgcttggaaagagggatgctagtttcttttattattgttattatactttaagttctagggtacaagtgcagaacatgcaggtttgttacataggtatacatgtgccatggtggtttgctgcacccatcgtcccatcatctacattaggcatttcccctaatgctatccctcccctagtcccctaccccctgacaggccctggtgtgtgatattcccctccctgtgtctatgtgttctcattgtgcaactcccacttatgagtgagaacgtgctttgtttgtttttctgtccttgcgatagtttgctgagaatgatggtttccagcatcatccatgtccctgcaaaggacatgaactcatccttttttgtggctgcatagtattccatggtatatatgtgccacattttctttatccagtctactattgatgggcatttgggttggttccaagtctttgctattgtgagtagtgctgcaataaatatacatatgcatgtgtctttatagtaaaatgatttgggagtaatgggatttcaagtttttgtaacctttcctggggtagaggaatctggtttctattacttgcttcagggatggcagagaggtaggagacaggaaggcagaaggaggtcagatacagactttgcttctgagactgctcagaggccttccaatatcttagtcagttcaacgtactcagcatgccaccatgccatacttggaggtatcattttctgagtcccaacactattaattttttcatgttgaatactacaataatatgtttatttccccaggtacattcatgtagtggtaacttatacagtcactaaaactagagtttatacacatgtttattgacttgatcatgatctagaaaagtgaacaaagtaacttcaaaacagcattgatagtatgtgatatcacattgtctattgtgtaacagtgattgtctccagattatccctttctttttacttattttgttttttctcgatttttttcaataaatgcatgtgtttacatagtttttttttataattttaactttttattttagatttagggagtgcatgtgcaggtttgttacatgggtatcctgcaacgttagcactctcaggatattcattttgagctattagataaaatcaatcaagtgctattttatttttaaactttgttttccactgtgtcagaagacaattccaaaatttatctgatggagtataaacaattaaaattatcatttgataaaaaaaagttgtaaattttaaatacatttgggttccagtggacaaacataccatcatgtaatgagattttaccgtgcagctagtgtgtcctttactcaccccatgagtttgacaacacctgctcagtgatattggtccacttaccatttgttatgaacctgcagcaatatcaaattgctatgaaaatttttaaatgtgtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaaaaaaagaaaagaaaaaaactataaatgaaaagtcaaggtctgtagccttgtggatcttcaaatggtagcgattcatagaactgatgttagagatgctctgaacacctgacatttgttaataaatgcgctgggaggtctcattctcataatatatgcaggatattgaagaggcagtgaaaagtcactattgtagcctgtatgaaaaacaagaaacattattgtaatatatcaataatatttacagtaattaggggaactgtaaataggaaaactaaacaaatacatctttgttgtttcttgcttgtttgtttgacactaatttgtcatactagaattattgtccatcaacttcacttggtagagctgcagaagttgttgtgtttctcagtgcacagggagctacttctaactccaaagacatcattaccctccctttagcctatattcagcccccagtcaaaattatcttatgtttatcttattttgtatcttcgtgaccaaagtgttattttttataatcatcaaccaaactgatagttaaataaaatagagttgaatttatattcatgaggctcttgaagataacacgtatttttcttgcaacataatttataaagataaaaccttgcatagattctagatgcacacaattaggtatatggtcaaataaatcaatttgcatctttttaatggaaaactaaacagctgtaaaaattaatatttaaaatattagtgacattgaaatatgtgcagataatatattaattgaaaatagcacaatatggaattatatatatagtgtattcacaattgcattacttgcatatacacacaagtatatgcaaagaaaataatacctgaattcaatatgccaaaatattaaataattttctgttagagtgattgagttgtttttattttttccctttctgtctatattttccaaattttcaacaggcattctgctgtttcctactatggcaattttatgtactaactacggatattcaaacttttgtttgaaattcaaacctaacaagtaaatggttactaaaattctcattatggtagatgcattcagctagacaaatattaattttgttattctgcctgtgccttttttctcagagatctgtatgaaaaggaggtacagagaggagcgtgaggttactgaacctgggagaatgagaatgttcttagcacagcaatgactattagacttaagaggcatggattcttataacagcagtttcacttccttctttcccaatagattgagacataatatttcctgtagtttattatgttcttttttcttccactaatccaaacctctgcaacatgcaatttatctatattacaaacctaaatagtaccctagcccccaaagggtttttttaaaaagtcaaaaataacaaatgttgatgaggctgtggagaaaagagaatgcctatatggtgttgctggaaatgtaaattagttcagccactatggaaggcagtttgaagatttctcaaagaacttacagcagaactagcattggactagcaatcttattaatgggtatatacccaaaggaaaataaactttctaccaaaaagacccatacatttgcatgttctttgcagcactattcataatagcaaagacctgaaatcaacctaggtgccccaaaatgtaggagcggataaagaaaatgtggtacatatacaccatggaatactgtgcagccataaaaatgaacaaaagcatgtattttgcagcaacatggatgcagcaggaagccattatcctgagtgaattaatgcagaaacagaaagctaaatatcacacattctcacttataagtgggagctaaatcttgaggatgggcagacgtaacgataggaacaacaggcattagtgactccaaaggtggggagcggaggaggggaacaaagcctgaaaaacttccttttgggtactacgttcactatctgggtaactgggatcaatgaagtccaaatctcagtatcatacactataccttgtaacaaatccacacatatacccccaaatctaaaataaagattaaaattttaaaaatcaaataaaaagtaaaaacacataggaggctattgaaataatgacatacctagttcctgattcacagaccagagacttgtaaatgaaatttggaatgtaaatcatggttatcaaggctgacttttcttttcagagttatatatgacaaagtatcttcctatcaagagtagataatttcctactaaaactaaacaaatgcttaaaaagcataccatgaagcatatttacttctctccaaatgaccaaaaatgttttatttattgctatgttgtttgtaaaattgtgcttttaccaaagtttagattaaatttcatctgtattaaaactgtttgaaatcaataaaatggaaatatctactataaaaaatcatactgtggcaatcttacatactaactacgatattcaaacttttgtttggaatttaaatctaaatagttttcttcaagaaaatatttttaagatttcagtttgtctaaaaatgacaatacttaaactaaacaccaagagagagaaaagggatttactgataaaattcagtgttaacatttaggaacaaaaaagtatgtaagaaaaaaatatatttctatcacctaggtatgcaatgatcaaagtatttaaagagaatttgaaacacaaactaaactttagaataaagaagctaaatatttatgttaccacttatttcttgaaatataaaactatattttgatttttaaaataagaaaaaaaagcttggggaaatgggatgaaagttatgttcagagttcatcaacaagcatttattgagcttcatatatgtgctctgcacagagcttcatatattccagatggaatctgtttacatttgaaaagtttgtagtaaaatatctggtgtcctcatagtcctttgatattctatacaattgttggtcttggccttgatggcccaggaaatctgtttgtcaatacaaatatagaataatagatacattgacattgacatctatctttccatctatatatccatctatccttttatctatccaacatgtattgaaaagattgaagcacagccaaacatttttctagatacaaagatataaaggtgaataaacacagtccctttgatcaacgacattatgaatataaagggtttttttcctcattgagcacaaatctttccagttgtctcaggcttaaaagtaaaattgtaatcaaaaggctgtgaatgggacagaaagtagacataactgaagagttgcaagaaatactcagtccaattacgatgaagttttattaaccttctccaaaatcaaaaacacatcttcacatcctacatctctctctttactatgatgcagggtacacatggcacattttatttttttgagctgctgtgtacgccctgcctctctttttatttgatacagtcttcacttacatatggtaatgatcatgactaatatatacatgtaccactgacatgttcaaaaaaaaaatataattatggtacccagagactatagaaactagatcaaaataataggcctaaaacaattaggtgaacaataattaggtgatccatttctgggtaattattttttaaaaacagatgttgcaactaggagaaatcggtttgagttaagaacggttggagtcgtctttatggaaaagataaaattcagtcgcagtctagagggcagatgagcccaggggatgaatgaagatattgttgggagaacaaggatgtgttatgacaaaatcacagaaattagcatggtgtgtaagtttaacggtaaggaaaatgctgtgtatgtgtgttcggggcctctctatgtataaaagtaatggaaaataaagttgagtaactcagtattggcatatgattagaatatgtatatttgatcattttactgtaattgttatactttgatctcctttagcagattaaccctttattagctcttaatttgaaacagaagaatttaaaattgctctgataaatgtcagctattttgtgggaatgggagttgttagtagtaggaattgaagtgggagatattagtaataggaatttacctaatacgtgttcagtaagtcaaaatttgcatgtatgtttctacttttctaggacacttctacatatgctatttatttgcatttttttgaaaacccttcttagggaggcaggatgggcattatttttgttttatacatgagtaacttgagaagcaggttttttccacttctctcagattcactcagtaataagttctggctagaagccacatctttcatgtttaatgtttggtggaaactagagtagagaaaacgtttcaagtgaattttttttattatcatgaaactaacatttgacagtgtttataaattaatttttaaaacacatagatttaaggaaaacaatattaaaggaaaagtagataagaataaggaaagattttctttgtaattgtatatgaatgtttccattttattggaatgtttagatatttttagaaaatgtaattgttcttatatgattgattttacatgtaaaaaaagaagtcattgcagataatcataataagaaactgaaacttaggacatattttcattttttaaaaaaatgtattctttcttgtcaacttttattttagattcaggggtacatgttgttacctgggtataccaggttgttacctgggtgtgttgtatgatgctgaattttgctgtatgattgaatatgtcacccaggtaatgagcatagtacccaacagatagtttttcaaagtttgtctcccacattccctccctaccccctcttattttcaccagtgtctaacattcccatctttatgtctatgggtacccaatgtttagttcccactttgcttgtggtatttggttttttgttttggtttttagttttagtttttttgtttctgcattaattagcataggataatgtctcaaaatgcatctatgttgttgtaaaatgacataatttggcctttttatggctgcatagtattccatggtatgtatgtaccacattttctttatttcttttttttttcctttaagttcatgtgcagaacgtgcaggtttgttacataggtatacatgtgccatggtggtttaccgcacctactgatttgtcctctaagttccctcccctcgccccccacccaacaataggccctggtgtgtgttgttcccctccctgtgtccatatgttctcattgttcaactcccacttatgagtgagaacatgtggtgtttggttttctgttcctgtgttagtttgctgaggatgatggcttccagcttcatccatgtccctgcaaagcacataatctcattcctttttatggttgcgtagcattccgtggtatatatgtaccacattttcttcatccagtctatcactgttgggcattgaggttggttccatgactttgctgttgtaaatagtgctgcaataaacatacgcttgcatgtgtctttatagtagaatgatttataatcttttgggtatatatccagtaatgggattgctgggtcaaaggttatttctggttctagatccttgaggaattgccatactgtcttccacaatggtggaactaatttacattcccaccaacagtgtaagtaattgtaaaagtgttcctatttctccacagcctcagcagcatctattgtttcttaactttttaataattgccattctgactggcatgggatggtatatcattgtggttttgatttgcatttctctaatgatcagtaatgttgacctttttttcatatgtttgttggccgtgtacatgtcttctttcgagaagtgtctgttcttagcctttgcccatttttgatggggttgtttttttcttgtaaagttgtttaagttccttgtagattctggatattagacctttgtcagatgggtatattgcaaaaattgtctcccattttgaaggttgcctgttcactctgatgatggtttcttttgctgtgcagattctctttagttcaattagatcccatttgtcaattttccttttgttgcaattgcttttggcatttttggtatgaagtctttgcccatgcctatgtcctgaatgatactgcctaggttttcgtctagggtttttagtatgttgggttttatatttaagtcttaaatccatcttgagttaatttttgtttaaggtgtgaggaaggtgcccagtttcagctttctgcatatggctagtcagttttcacagcaacatttattgaataggagatcctttccccattgcttatttttgtcaggtttgtaaaagatcagatggctgtagatgtgtggtgttatttctgaagtttctgttctgttccattggtctatatgtctgtttttgtagcagtaccatgctgttttggtgactgtagccatgtagtgtagtttgaagtcaggtagtgtgatgcctccagctttgttctttttgtttaggattgtcttggctatacagggtcttctttgattccatatgaaatttaaagtcgttttttcttcttctgtgaagaaagtcaatggtagtttgatgggaatagcattgaatctataaattactttgggcaatatggccattttcacaatgttggttcttcctgtccatgagcatggaatgttttccatttgtttgtgtcctctcttatttccttgagcagtggtttgtacttccccttgaggagcaacttcacatccctagttagctatattcctaggtattttattctctatatagaagttgtgaatgggagtttattcatgattttgccctctgcttgtctattgttggtgtaaaggaatgcttgtggtttttgcacattgattttgcatcctcagactttgctgaagttgcttatcagcttaaggagttttgggctgagatgatggagttttctaaatgtagattcatgttgtctgcaaacagacacaatttgacttcctctcttcctatttgaatacccttacttctttctcttgcctgattgccctggccagtacttccaatactatcttgaataggggtagtgagagagggcatccttgtttttaaccagttttcaaagggaatgcttccagattttgcccattcaatatgatattggctaggggtttgtcataaatagctcttattattttgagatatgttgcatcaatagctgttttattgagagtttttctttatccagtccactgttggtaggatccttggttgattccatgtctttgctattgtaaagggtgctacaatgaacatatgggtgtcttcttggtagaatgatttattttcctttgggtatataccaagtaatgggattgctggattaaatggtagttctatttttagttatttgagaactctcctaactgctttctatagtggctgaactaatttacattatcaccaacaatgtttaagtgtttttgaaccattgcccctttcctctctcccatcttttgtattatccagcatctattgttcccatctttatgttcatgtgtactcaatatatatttcccactataagtgtgaaaatgcagtatttgatttgttctttctttattaattctcttaggattatgtcctaatggataatggatagtgacctaatagcctaatggataatggtccaagttcagagtctcatctgagacaagggaaatcccttccacctagtgcctgtaaaaccagaacaagttagttacttccaagatacaatggaggtacaggcattggttaaatatacccattccaaatgagagaaattggtcaagggcctacaggccccatacaagtccgaaattcaataaggcagtcataaaccttaaagttccaaaatgatctcctttgaacccatgtctcacatccaggtaacactgatgcaagaggtgggcttccacagacttgggcagcgccactcctgtggctttgcaggctacaacctccctcctggatgctttcatgggctggtgttgtgtgtgcagcttttccaggtgcacagtacaagccgtcagtggatctaacattctaaggtctggaggatggtgggccccttctcacaactccactaggcagtgccccagtggggccactatgtgggggctcctactccacattttccttctgctctatcctagcagaggttctctatgaggactccacccctgcagcaaacttctgcccggacatctaggcatttccatacatcctctgaaatctaggcaaagtttccaaaactcaatttttgttttctgtgcacccataggaccaacaccatgtggaagcttccaaggctagggatttgtatcctctgaagcaacatcttgagctgtaccttggccccttttagctaggtttgaagaggctgggacacagtaccgaggctatacacagcaggggggccttggacccgacccaggaaaccatttttttctcctagccctctgtgcctgcgatgggaggggctgctgtgaaggtctctgacatgccctggagacattttttccattgtcttggtgattaacattgggccccctgttgcttattcaaatttctgcagcctgcttgaatttctccccagaaaatgggtttttcttttctatcatatcatcaggctacaaattcccaggcttttttgtttgcctcctcttgagcactttgtcacttagaaatttctgctgccagatatgctaaattgtctcactcagattcaaagtttcacatgtctctagggcaggggcaaaatgctgccagtctctttgctaaagcaagagtgacctttactccagttcccaacaagtttcttgtctccatctgaaaccacctcagcctggacttcattttttacatcactatcagcattttggtcaaagccattcaacaaatctttagggagttccaaactttctcacatctgtctgtcttctgagccctccaagtctctgggaagttccaaactttcccacattttcctatcttcttctgagccctccagactgttttaacctgtgcctgttacccagtttcaaagttgcttccacattttgggtatccttatagcagcaccccactctaccagtacaaatttactgtataagtctgttctcacgctgctatgaagagatacctgagactgagtaatttataaagaaaagaggtttaattgcctcctcacagttcagcatgcctgggaaggcctcaggcaacttacaattatggtagaaggggaagcaaacatatccttcacatggcagtaccacggagaagtgctaagcaaaagaagaaaagccccttatagaaccttcaaatctcatgagaactcactcactatcacaagaatagcatggatgtaaccacccccatgattcaattacctcccaccggatccctcccgtggcacatggagattatggaaactacaattcaagatgagatttcactggggatgttgttgcatatgagatgggtttcttgaagatagcagatggttgggtctagcatttcatccaacttgccacactgtagctttcaagtagggtgtttagatcatttgcattcatcgttaatagtgatatgtgagaatttgaccctgtgatcatgttattacctggttgttttgtggactcgattgtgtagttgctttatagagtctgtgaactatgcatgtgtgtatgtttttgtggaggcaggtattgttcatttgcaggtttagaactcccttaaagacctcttgtaagactgttttggtgataataaattcccttagtgtttacttctctggaaaggattttatttctcctttgcttatgaagcttagtttgacagaagatgaaattatctgaaatttttttaatgatatgaaaatagacctacaatctctttttgtttgtaaggcttctgatgacaatcctgctgttattttgatggggttctttttgtaatagacctcacccttttctttagctgcctttaagattttttctttcacactgactttggaaaatctattgaatatgtgccttagagatggtcttcttatatctcataggggctcaacaaatttcttgaatttgtgagttgacctctttcatgagattgggtaaatttttatgaaatgtattctcaaatttgttttccaagttgcttactctctttctctcacaggaatgctattgcataataggcttggtttatttacataaccctgtatttcttggaggttttctttctttaaaattttttttaatttatatttgtcttactgaattggttaaaaggaccagtattttcattctgagattatttcctcagcattgtctattctatttttaatgcttctaattatattttttaatttctctagtaagtttctcaattccagaagttcagttttgttttttcttaaaatgcttgtgttgtctttctactcttggattattttactgctgtctcggattgggtttcagctttctcttgaatcgcattgagcttccttgttaccaagattctgaattctatgtctgtcatttcagccatttcaatttggtaaggatccattgctggagtgctagtgtgattgttttgaggtgaggagatactctgactttttgaattgccaaagtccttgcactgattccttcttatctgagacggttagtgttattttatctttcagaagttgctgtcatttggatgaggcattttgtttttatattctttttctctctggagggtgtgactgtagtgaatgttttgtattgttaattggctttgtttctgggtgctttcagagggttaagcctctgtacaggttatttaattatagctagatctctacattgtatttcacaggcagtgtgtggaaggcatttttgtttggtggtgtaattcagactgcgttccattagatggcatttaagaataagagtcagcaggtatgttcttattcaactgtgtgccttttttgtatttcagtgcatttgtgtagtgttccaggttggaggagttggggggaatcaggggatgactctctcaccaagttttcattcctgggacttgggggagctccctgtagtctctggtgctgtgcccacatttctttagctccaagggaggcctaggctggcagtgctgtttcctcccatggagtggcctgagccaaaggttaggttggcaggagacccgtagtcccctaggggcctgctatacctctgtacttgacagagtcagagagggttgtggggtatgtctgctggtggtctgttgattcagtcggtcagaggtggaggatcccaggaagggcagtgttgctgtgggtgtgcagctggtgtggtacccagggcctagagttttttgcccagagattgctgtctggacttcccagcttgtgcttgactgatcaggtctccttccagtgtctgtcccagtactgagcttgcccagctagttttgtcccaagccttttgttctccgattgcttgtctgttaggtgctgcagggcatggagctccctcaggcagaggctgaggatggcagataggccacacccttcctagattggtcttccagagcatggtatacccagctgctgtgccatcccatgatcccacacctcagtcttctctgtggtctgagagtgagggctcctctcctgcttgagctcaagatctcagctcaatacccctgagccgtgtgttcaaattctagggagttgagaccaggcatgcagctttgtccttctgcccatctgggtcagatactacctgttctgcgggagggcaaagcaattccagactaatggcgagacactcaggtggggcagtagaggttgcattgtcggcatgctcttgatggagtggtcaggcaggggctttgagggtggtcaatggacaaggggatgtgcagaccagacatgcccctttcccatgggaaaaacagccctgtttcctgcaccccctcatgcaaaatcttctgagttcttctcagatttgagctctgcctctgcttactctccaagcagttcccctgccgattcaaatgttttttggggtcacaggatctctcatagctaggatctcagaggtctgtggcaggagtgtggtgtcccgcagttcctttattcacttcttccttaggacctgttaagggctgagagccagttctggtgctcagcaactttgtgcagcttcctccctcttcatcctcagtgtttgtgttgcctctctgtggactttcagttttctcccagaggatctgcttgaggtgtgatggttcactggatattttggtttctcttggttggagagttgcttcttggctgcatctagtcagctatgttggccccccaactccaaattttcatattaaccttttaattcaacttgctttgtttttgcatgtatgtttgtgtgtgtatgtttgtgtgtgtatgttttgtgtgtatgtttttgtgtgtatgttttgtgtgtatatttgtgtgtttgtgcatttctttatgaatggctaaatttacttaatcagcttggttatacagtcaattcgaatgagccattgagaactttggataactatcactggtttctattgaataaacaagtattaaacatgtaggtgcattccaaaatgtctttagcaaggaaatttctagagataacattccttatcattaaatggctaagattctatatggtaagttatgttttgtaagtggggcaactaaggccagataccatgctctgcatttttagtttattatatctaatgtttatagttttctaacttaggtagatatatgcttattttataaatgaagagcttgagtttaaagcaaataggtgacttgttcaagaacacagagataaattgaatctatacttttttttaacttatatgtataatagaaaaaatccataacaaaaagctttatataactggcaggtgacgttttccaacttttggttaagctgagtaacaaacagtgagttccccatttctgctaatgttttagagaggttgggtgatcatgtgataaagatatattagtgagattcatatagtggatacgaaattattaaaaaataacctctaagttcaacttcaattctaatattttatcagtttatcgccatgtcaacataaaggtacagttgaagctactgttttaatttttccttgttttaggaaaccagttgatacattgttctagacctttcctagggaatggtgtcagctttcacagaaagttgtctgcttttcatttccagtcaagaaaactctagtgtttgacacatagctctttgctctttgatttgattggccatatggagttgttaaaacatttaaaagctgatctcaattggactttcagttgataacaccttggtatcctcttttgtgcagtcataacccatgccagttttcatgagcttgaacattcattactgggttcatgacccaagccattagcccatcactgccatgcacttgtcaacagcatctgaaagcatgaagcttaaacctatctggtctctggtgttattcaatttgtgagtgaaaaaatcacacactacctagttaatgtgtgtatatatttttcccttctcctttgaatttgaatgttctctgggttttctaccattaccagtaatgctaattatttaatttgtctctgtcacccacatctgtgataaaatagtttgtttgcacattgtactccttagcttttaatttctccaagatcctattatatttaaaagatttaaaaatgtgaaatctcttaagtagagaagtcactaagtccttgtagaccataaggattgcctgctctcctcagactcatggttaagtggcatcagtggtctgaaccattcagctgtgttgttctctaaggcccaaccaaccaccaaggtagagaaggaacatatctgtgaatcagtgtacagtacctgaaatgggaaggttagttctgtgtctaggagacatggtgcgcaagttacttgacttctgtcagtggccatatcttcttcacctataggactgagaggataattcctcttatgcctttcttctaaaggcattgtgagcatcacaggcctatgctttctaaacattataaaccacttaaaacattcttgactccatctcttattgaataaaatttatttttcatttctctagactctatgactttgggcaagtcaaccagtatttctgggcattagttttgtcaaagcacctgagtgataaccacagttatttattgggagttgagtatgtgcccatcatcgggccaataaggtttggttaactgtatttattcctcatgaattattttcattgccttcacttgatggctcaggaaatggagcagagagagctcggtaacttccctaggctcacatagctagttagtagcaaaggtggaggtagatgcttcaggtcattaaataaggtagcaaaggtggaggtagatgcttcaggtcattaaataaggagggattaaaatatttcatggaattatcctaggtggcgtctaggttcaaagaatgtaaaatgcagagaataaaagatctgctttttttttctttgttttggccaacttttttcaccagcctgtatttcctctcctttctttcttatctgttttgaaattccaattgctgccttcactttggcagggtagatgggggtggttagagttgccttccctactgtgcttaagttcttattgtgtaaagatcctgtaactcgctaaattagcttaaaaagctctggttttgttttcgtgccagcatattacctcaccacactatcactttttaccctccaagacttgccataccaagtggcagtgctcaaatcacataaagaggagccgttgttgcttgttcgctagtacgtgggtttgtatccccaaaccatgtcttttttacatgatactaattttgtctggaatattcttatttttccatacaaaaagcaaattcctgcttttccttatgaaacatcagtcagttcttctgtatactcaaccatgactttcccagacatcttttttttttttttttcctttaagttgccagcatgacttttatgcttagcaatgtttggattccatgttcctaaaccgaattttctcagagcagggatgctggtttttgctttctgcattttcagcatcaaacacagtatctagcacgtagttacgctgttgtttcagcaaatgaattactactttggtacaacagaccctaattttaatttgaagattgacacaattgtgaaggtatactaaaaagttttcttgaaattttagatgaaatataagtagtagaggatattttttctccttccaaaaattaaagagaagaaaatcactcagcttaattttcgtttaacaaaaaagaaccaaagtgttatgactaacactgtcacagagtatggtgtgattactgatgatcaaacttctgtagcaagttacatgtatatataaagactaatactgttcttccaattactaaggtaagttcttagaagtaaaaatatttatgtttagattcctgaaatagtcactaatcatgaaactgtattgaagcaaaccaaattcctggaactagacagactgtgatagaatccagtaggctgatggaggtactctgcatgacagcggggcagatggatttgctgaaatccagtgttgcccaactacaaatctgccataaaagaaaaatgcaaacatggagacttttaaaataggaataatttggactctcacagaggaacattttcaagttatggtttaggtgggcttcttagagccatcctagattccaagaactaaaagtaactgcagacatcaggcagagatggtccaagttgtcaagcagaaaataaatgcattactcaaaacatgccatctcttcataagcactcttagaatttccatgtttaagaatttatttttttttctaagactgggattctttatatgaaagtatttttttttctccttggttttttaaacatctcaatacaatggcaattaattctggaaagtcaaaaccagaaagcgttttagagagtcttccttactttgccataaggtatttaagatggaagtctgttttagtttttcatagatcttacaaggcccagtccagtgcttaaaacattttaatgttcaattaattttatttgagctaaattggattcatatctactgctcaccaccatccacaagcatcatttcaaacctgtttgggaattaaaataaatgaatcctgggatgactatggtttgtctcaaggtcaaaagctgtgacagagctagatttaacatcaacagattccttcttatttatgttactaatgagtattaatatatattactgaactttttgaccttctgtaatgaaaatttctgattatagatttattttgttatgctaaaatatatgcaattttaaagaaaaaggacaccatcagtggttggcagtcagagccagggattttcttgagagctgatactgaagtattattgaaatgatataataatatattattgaaataatattttttttccattttcttcccaaaggatgcctataatgctctggatgactctccactctcagccttttatatctagcacctcattcctgaaaactttcatctcttttcactattccatgtattctgacagcatccgaaatttaccttacattacttatatcattttcttgtgtataggaacaattctactcattaataccaccactgctgctattgaaattttggttctatgaatatctcaattatattccttcttctttactttattatatagcctttttgtcctggtttattccttagagttttatgctttgcttatatacaatgtacattgctatgtatgtctttaagttagtgtacagatttttaactgtcttaattgttttagaaaaatatctagtcttccaaaagtagatcaatatcagttaattggcttatctaccgagtccttaggatgatgttgtatttgtcttcataatcattgatttatttgttcctgtttgtctttgaaggaaggtctgtctatctagactcagtgtttatttctcttgactttgctgggtcttccaaggtccacacatccacaggtgcagttgcctagctcccagctcacttctcagtgtctaatcaaattccaactgttgcattcctgtaataattgatattgtgtctttacttatcgctccaattcttaccccttcagcactgaaaacagatagtgtacatgaaaaatcacattgcacccccagcagtatctttttaggaagatcggtgttggtcatgcccaagacaaaactccttagttgtagggaccttatatcccgcaatatgtggaatccatcactatcttcttaacccatcctatatacgaagatattttctgcaatttgacgtccctaatagatattgtaagagagacactatagggaggagagggttggaaagtaaaggtcacatactttaagtagtacctaagcagcagacagaccgcccataattatctgataaatgcagccatttgaattttagatgtaatggacagacagtcagacaatagtaccatggcatagagttttttttattttggttttgattatgtttgtttgtgtgtgcgtgtgtgtgttgtttttaaactactttttggcaacatagcctggtggtccaaatgttgggatttttagttaaattctagaaaatatataggtcacggatgttcttcccagtgtcttaaaggttgacggttctagttttcagtgtaatatgatgtctactatatacaactatatatgtctttattaacaatctaatagagcttttggagagcatgtgacaaatacagctaaccaggcacaattttaatattaactatcatatgactttttacttttttacgttttaaagccaactttttctactttctttatacttttctaagtgtttcaaattattaaaatatgtcttataatttttaaagatcctaggattaataaatcactgaaactttaacgaggtgcaatatcaaggcagtcttttgtttcagaaaatgattacaattattaatgaataacaagcactaatacaactttgtacatctttttgttatgtgtatgactgacatttatttatttgaggttatggtaaaattaaaattctatactatatctaataaaactagttttagtatttgtgcaaacagaagttgacatttgatggagatgcaaaaggaaaaaaatactcattattctaggttttagattggaatctaaacatttctaattgaaaacagtttaggaattaaagaaaccttgtcctagttctgccttcctctggtgtgtgtttaggttcatgtcccttaatctaagggaaattagatagctaaaagtcatcagtgaattcagcacacctttattttagcctttgctgtaaattaaggtctgtgaccattattgaaggtttacctgaactccttacaatattagttttccatttcttcttgtcctgagtttgtgctaacaaaatcatacgaagaaaaagagaagaaaggccgaaattatgacagagagagaaatataggatagcttctctgaataaagcctaagcctggggacaggaagtctacagtgtgccatatttctctcctttccttctggtagcccctgggggccattgtgaaatctccagggagtccaggagcacaggatagaaaccatgacatgggaggttattgtgagattaaaggatgtaatatatgtgaactagtaatatgcaaactttacaaatgtaagattcagtattattttactttctatcaatttaatgtattttaaagtagtcatcatcttttcccaatgtattatttattccacatatttgaagcaccatatcatatcacacttatccttaattgtcttcaggtttgcagtatttaaattaaatcactaattcaaattgaaaaatgagaggaactattagtttgtagaaatgtacttattactagattaaagtgtggcaattccagttttttcacgatcaagtgactatgtggtataatatgttttcatcaaaaggctgcatgttattatgaatttttaaaagagtgtgatagtcggctccttttttaaatttaattttaattgaaattaattttaattttaattttaatttaatttaatttaattccaaaatattttctttaaataaaatttgacatcatcatagaaaattatatgatatcaacaaacttcttttctatggtaatattactgtatggtaagtttatatctcattatttctgtgattgctatctgcgctttattttattttctcaagaaaattgaccattttcactaataatataatttactttaagtaaaggataggctctgcatatattaacagagttgtttgagttccagctttcattgaaatgatttcctgagaattgattgcatgccggatgctaatctttactacaatagctgaaaattcacatttcaatatatctaacagcaaatgatcagactgctacccagacagtgtgattcatctatagccatgttaggctgaaagtataaataaatcaataacacacactggtgataaggaaatgttctcaaaagtacatgaaagaaaacaagattatttcataaacaagtctatatattcacaacaaaggagaaagtagaagtttagattattataataaaaaaggcatctgctttatgtataattaaatagtttttctatgagtctgtaaaaacttttacacgaataattgccttatttttcctttgtagttatgattacttaaatatcaatttattaaatgcctgtcctgtgccacacctatattcagtgttagaaagatgaatgagggattataactgaacttaagggtgagataaagctgtgggcaaatatttccagtaaaatgtttgggtgttacgtaatactggaaatctgtttaagacaagaagtataacagcggaaagatggactttctgtggtggaggctttacaaaggaagtagagctttagtagggttttcaagaataaatagaaagtgtgaaatgacaaaggatgggccagagacattccagattgaggcaacaatagtcttcacagtacagatgtggccagagtgctttctgctcggtatttgagaaatgtcttatttctctcttctatgattcaatttattggctgattattctgcccaagccaaaaaatatgtataacttctgtttatgttaatccttgtaaatccatctctaatgcacagagagctgcacgtggaagaaaatgtgttagatcagttttcagatttgactgtacaaaaacttgggttctaaagacatgtctgtggagctgtggaaggaaaagctgcatgaaggctttcctgattccctgcttcaaccagaacagtctcactttaaattggttttaatattgagatttctcatttggaataaacaaaaacattgaattgcaaaaagaaaatatgtttaactgaaatctcctatcaaagacagccttgtggtcgcttttcttgtttaatctcttgtagatgacagaaaaattgagagcttgtttatagacttgggaacacttaggctttgaaatccatatttacttacttgaaggtcagtcatttttgccccctgatgattttagaaaatgtcagggaaacaggcacagtaattgatcatattaggatggagtgaatccatgaagaattgacagcttgatctcgaaagctgtagtgtatgtatgaggatttgtagagaagtagaaaataagtaaaggcctggagaaagcagagtaaacatagagtagaacctgtacagagtcaaggactggtacactggtctcaattctactctttataaacaaaataaacaatggaaagttacggtttaattcctggattacatgatggttaaaatggaaggatagtttttaacaagaaggtacatttaaacaaacaaggactccagggtactcagattcttcatctgcctattttactgtctatttcatctatttctgggaacattatgtacagaaaatataagattaatccaattttagcatgtatcagaatcacctggtggatttgttaaaacatgaactggtaggccttgtccctggaatttctgattcagtaggtttggggtacgcgttaagtattggcatctctcgttaagcgccaggtgatgctgctagtcccagaactaactcagagaatcactgagataaacaaactgtataaataaattcctggaattgagtgtcttcttcaaataaaaacaaaataactcccatttttctgcccaaagagttgtgaaggcctttgttattgaaaacattaaatgaattgttaaaaaattaaaggtttaaacattttgcctaaatgaatattatagtgctggctacatttattttaatgcatttttggggatcgtacaacatctgctactggtatttcccacaaaatttgacctgtgtttcttcaactcttaggtttaccttagtctacaacttttgctttcacccgcccgtcatgtgaattttaaattttacattttgattttcaagttgaactttcatgttgaactgcttatgcttctcaaattgctcctttttctgcaatttaagtataatacaactggatgaaagaaggagtctcttacaaaatgtagctcatagctcataaagatatttgcaaactcaccttttttaagaaacaacaaatgtaggcttttcaataaaatacgtgaacttgagctctttataaaacaccacttgaagatcattgactttgaaacaaactaattttactttattgaatacctttttcccttcttcaaagatttccaatgctgtatattgattgttctgcccttttcaatgtcattttgtttttcttgctgcaaaaccatactctgagttacttaaattgtatttatcattcccagtattatttttttctttagcacaaacccaaacttattaagaatgctgtgatgttaatttcagaagaggatagcactaaaggcagaataattctgatatccaaatatttttataaataacatttgaaaaacagtatatattttggtttagtctactattaatagaggaaagttatagggaaacatattttgttctaataagaaagaatatctaaaaaaacagagcaggaaatcaattaaataatttgctgatactttcataaatgtcttcaaattatgttgtgattaatacttataagaactatttttcaggaggttccagaatagagtgagtgttcatctgagaactcatctgatccccttacagttctaacagggactttatatgctaatttttctcctaatgatggttttctatgtaatgtaacaagtcttaaagttttcttaaatattcatgtattaaagtgtataaaattccttggagtgttttattttagagactttttcattaatagatacaattttgttgattatagtttaaatggaagggatataagtcaaagaaatattattctcaatatgaattatgaaaggagaacaactttaaaaatacttcataatgaagtaagaaaaagagtacatgaaacatcttttgggtttaaagatatgaacaagtgatttctggtgatttttttctttttaattgcaagtctgtttggctatttctttggcttctgagcatctcttaagagagtgaatgaaaaggtaatcattaccctttagaggtaaaaaaagtctctgcaggtttcatagaatctatttgatttcaataagcattaaaatgtgttgtaattttgcagggtatctcattgaatgtagagccaagattgattctgttgagagctcaactagatgaaaaacgtagccagtatgaaacactcttaactggctcacatccttgcagtgggactatcacacacccaggcacccttacttgcggtaactggctactgattcagcaactgaatgagagaaaaagattcttaatgaacctggatcagagaccagattgctgaccagctcctggagttaataatccatcatatgaagtaaacacataaccatcactgaagttagagtaatgtaagcgttgcacctgacagcagtatggtgtagggagaatgagtgcagttattcctggcaggtttgtactggaatcttagcctagatctttactttgactttatgccaattatttaacttgcttttgtcactgaaaatagaaacacaatcaagacataatatctaccttccctcaaggaatttatggaaaacatagtcagttgttgatgctgtcaagttattgatattgtgataaatattatgcacaattacaatagaggtttgtagagctacggtaagaatagtatagtctgcccttggaagccacaggagggttgcctaatgaaagagatcagggaaagtttcctggaggatgggacatcttagctgaacatagtaggaaaagtagaagcaatagctctttagtaaatatgcattcagtgcttgtctcttacatgtcaaacactcagataataacaacataaatgaactgtttagtaggacaattccaatgcaatagaaaatcttactatgcatcttccttcagacgagaacatagatgtttagggaggtcttataagatcattccttgtacagtgccttgaagctgagtggggagtcaaagttaacatttatctaaccctgtgtagtgctctacagaatgttagaatagtagatttgaaagtcttttctattaagattatattgaagctttggaaatgaatgagaatgctaattgatcataggatgaaggggaaagaaatctgagcatatattataccagagggattcccttcccataggaagtaagaatatgaaaaaggagctcaaaaaataagtggaaaaactcgaaaaaggaagaatgttttcaaaagagcatagtcaataggagtagatagtccataagttaaaatggtaataaagttctgatggatttatccttttgcaatttactagttgtattcatccattctcatgttgctacaaataaccacctgagactgggtagttcaggaagaaaagaggtttcattgactcacagtttcacaggcttaacaggaatcatgactgtgaggcttcaggaaacttacaattcgggcagaaaatgaaggggaagcaagcatgtctcaccatagccaagcagaagagagagagagagagagagtgaaatggggcatgccaaacatttttaaaccatcagatcttgtgagaacttactcactatcatgagaaaaacaaggcggatatctgcccccatgttccagtcacctcccaccaggcctctcttgcaacacatggagattacaattcaacatgaaatttgggtggggacacagagccaaaccgtatctttctgccactgggtcctcttaaatctcatgtccttctcacatttcaaaaccaatcatgccttccaaacaatcccccagtgtcttaactcattccaggaataactcaaaagttcaagtccaaggcaaatcccttccacctaggagttacttctaagatacaatggaggtacaggcattgtgcaaatactcccattccaagtgggaggagacatggatctcctttgattccatgtctcacatccaggccacactgatacaagaagtgggctcccaacatcttgggctgctcttcccctgtggctctgcaggatacagccctttggctgctttcataggctggcaatgagtgcctgtggcttttccaggtgcatggtgcgtgctgttggtgggcctagcattctggggtctggaggacagtggtctttttctcacagctccaccaggcagtgccccagtggagactgtatgggtgttccagcctcacatttgccttctgcactgccttaggagaggttttccatgagggctccgcacatgcagcatacttctgcctggacatccaggcgtttccatatgtcatctgaaatccagacagaggttcccaaacttcatctcttgtcttctgcacacctgcaggcccaacaccatgtggaagccaccaagacttgaggcttgcaccctctgaaccaatgatctgagctgtacattggtttcttttagctatggataaaactggagtgctgggatgtagggtgccacgttccaaggctgcacagagcagctggcccttgggcctggcccaggaaacaaatttttacctgctaggcctctgggcctgtgatgggaggggctattgtgaagatctctgacatgccctgaagacatttttctccattgtcttggctgttaacatttggcttctcttcacttatgcaaagttctgcaggtagcttgaatttcttccaagaaaatgggtttttcttttctactatatggtcaggtcacaaatttcccaaacttttatgctctttttcccttttaaacagaagttctaatttcagaccatctctcaggaaggcatatgactgtatgctgttaggagcatccaggtcacatcttgaacgatttgctgcttagaagtttcttccaatagatatcctaaataatctctctcaagttgaaagtttcacagatccctagagcatagcacagtgctgccagtctctttgctaaaatatagcaagagtgacctttgctccagtaaccagtaagttcctcatttccacctgagatgacctcagcctggaattcattatctgcatcactatcacccttttggtggaaacaattaaacaagtatctgggaagttccaaactgtaccacatcttcctttcttcttctgacccctccaaattgctccagcttctgcctgtttcccagttccaaagtcacttccacattttcaggtatctttatagcagtctcccactctgctggtaccaattttctgtattagtttgttctcacactgctataaagatctacctgagactggataatttatgaagaaaagaggtttaattgaatcacagttccacaggcttaacacaaatcatgactggaagatgtcaggaaacttgcaattatagcagaaggtgaaggagaagcacacgtcttaccatggtggagtgcaagagagagagcaagggcgcagttttaaaccatcagaactcatgagaactcactatgatgaaaacaacaagaagaaaatccacacccatgatccagtcacctcccatcagacccattccccaacatggggggattacaatttgacatgagattaaggtggggacacagaaccaaaccatgtcactagtagtgcttggtataagaatattcattaggctgttgagtgttaaagcccagaaatgaggcattagtgggtgaatgttgaaagcgggagctgatgcagtaaatttagcccactcttgctaaaattgtcttggtggagctatagatggaggcagcaaggtataaaacaaatattcatttgtctgcttgtttgtttgaagactagagactttttaaggaattgcttctcttgttattgttaaaccattttgttataaattttatgagatctaatgggaatggtaatatacagcctagaatacgaatttcaaaattataaatataatgattgaatgttatgtatgaacactcagaagaattttgagttttgcccttcatgttaggaaaaggtgtaatttcacaatattcccttcaaagattaaaaagactgggtttagagtattgtattaccaagtggagggataatctttttttttccctttccttttgtgctgctcttccaagatggcattcagaatttgaatttcaccagtggacacttgttgattctaatagtccctttctttttttttttaaattttatttatttattattattatactttaagttttagggtacatgtgcacaatgtgcaggttagttacagatgtatacatgtgccatgctggtgcgctgcacccactaactcgtcatctagcattaggtatatctcccaatgctatccatcccccctccccccaccccacaacagtccccagagtgtgatgttcctcttcctgtgtccatgtgttctcattgttcaattcccacctatgagtcagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggattgctgggtcaaatggtatttctagttctagatcctggaggagtcgccacactgacttccacaatggttgaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttgttttgagaagtgtctgttcatgtccttcacccactttttgatggggttgtttgtttttttcttgtaaatttgtttaagttcattgtacattctggatattaaccctttgtcagatgagtagattgcaaaaatttcctcccattctgtaggttgcctgttcactctgatggtagtttcttttgctgtgaagaagctctttagtttaattagatcccatttgtcaattttgtcttttgttgccattgcttttggtattttagacatgaagtccttgcccatgcctatgtcctgaatggtaatgcctaggttttcttctagggtttttatggttttaggtttatcgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgcagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtaattggtagcttgatggggatggcattgaatctgtaaattaccttgggcagtatggccattttcacgctattgattcttcctacccatgagcatggaatgtccttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgagactttgctaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgtcagttttcaaagggaatgcttccagtttttgcccattcagtatgatattggctgtgggtttgtcatagatagctcttattattttcaaatacatcccatcaatccctaatttattgagatttttagcatgaagcgttgttgaattttgtcaaaggccttttctgcatctattgagataatcatgtggtttttgtctttggttctgtttatatgctggattacttttattgatttgcatatattgaaccagccttgcatcccagggatgaagcccacttgatcatggtggataagctttttgatgtgctgctggatttggtttgccactattttattgaggatttttgcatcaatgttcatcaaggatattggtctaacattctcttttttggttgtttctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactttttttggtaggtaagctattgattattgccacaatttcagatcctgttattggtctattcagagattcagcttcttcctggtttagtcttgggagagtgtatgtgtcgaggaatttatctatttcttctagattttctagtttatttgtgtagagttgtttgtagtattctctgatggtagtttgtatttctgtgggatcggtggtgatatcccctttatcattttttattgcgactatttgattcttctctctttttttgtttattagtcttgctagcggtctgtcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgtcagggtgtcaattttggatctttcctgctttgtcttgtgggcatttagtgctataaatttccctctacacactgctttgaatgcgtcccagagattctggtatgttgtgtatttgttctcgttggtttcaaagaacatctttatttctgccttcatttcattatgtacccagtagtcattcaggagcaggttcttcagtttccatggagttgagcggttttgagtgagattcttaatcctgagttctagtttgattgcactgtggtctgagagatagtttgttataatttctgttcttttacatttgctgtggagagctttacttccaagtatgtggtcaattttggaatcggtgtggtgtggtgctgaaaaaatatatattctgttcatttggggtggagagttctgtagatgtctattaggtccacttggtgcagagttgagttcaattccttggtatccttgttgactttctgtctcgttgatctgtctaatgttgacagtggggtgttaaagtctctcattattaatgtgtgggagtctaagtctctttgtaggtcactcaggacttgctttatgaacatgggtgctcctgtattgggtgcatatatatttaggatagttagctcttcttgttgaattgatccctttaccattatttaatggccttctttgtctcttttgatctttgttggtttaaagtatgttttatcagagactaggattgcagcccctgcctttttttgttttccatttgcttggtagatcttcttccatcctttggttttgagcctatgtgtgtctctgcatgtgagatgggtttcctgaatacagcacactgataggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttgtccgcaaagtattttatttctccttcacttatgaagcttagtttggcttgatatgaaattctgggttgaaaattcttttctttaggaatgttgaatattggcccccactctcttctggcttgtagagtttctgcctagagatccgctgttagtctgatgggcttccctttgagggtaacctgacctttctctctggctgcccttaacattttttccttcatttcaactttggtgaatctgacaattatgtgtcttagagttgctcttctcgtggagtatctttgtggcattctctgtatttcctgaatctgaatgttggcctgccttgctaaattggggaaattctcctggataatatcctgcagagtattttccaacttggttccattctccccgtcactttcacgtacaccaatcagtcgtagatttggtcttttcccttagtcccatatttcttggaggctttgctcgtatctttttattcttttttctctaagcttcccttctcacttcatttcattcatttcatcttccatcactaataccctttcttccagttgatcgcgtcggctcctgaggcttctgcactcttcacgtagttctccagccttggttttcagctccatcagctcctttaagcacttctctgtattggttattctagttatacattcttctaaatttttttcaaagttttcaacttctttgcctctgctttgaatgtcctcccatagctcggagaaatttgatcgtctgaagccttcttctctcagcttgtcaaagtcattctccgtccagctttgttccattgctggtgaggaactgcgttcctttggaggaggagagacgctctgctttttagagtttccagtttttctgctctggtttttccccatctttgtggttttatctacttttggtctttgatgatggtgatctacaggtgggtttttggtgtggatgtcctttctgtttgttagttttccttttaacagacacaaccctcagctgcaggtctgttggagtacccggccctgtgaagtgtcagtctgcccctgctggggggtgcctcccagttaggcttctcgggggtcaggggtcagggacccacttgaggaggcagtctgcccgttctcagatctccagctgcgtgctgggagaaccactgctctcttcaaagctgtcagacagggacatttacgtctgcagaggttactgctgtctttttgtttgtctgtgccctgcccccagaggtggagcctacagaggcaggcaggcctccttgagctgtggtgggctccacccagttcagttggagcttcccggctgctttgtttacctaagcaagcctgggcaatggcgggcgcccctcccccagcctcactgccaccttgcagtttgatctcagactgctgtgctatcaatcagcgagactctgtgggcataggaccctctgagccatgtgcgggatataatctcctggtgtgctgttttttaagccctttggaaaagtgcagtattagggtgggagtgacctgattttccaggtgccgtctgtcacccctttctttgactaggaaagggaactccctgaccccttgcacttcctgagtgaggcaatgcctcgccctgcttcggctcgcgcacagtgcgcgcacccactgacctgcacccactgtctggcacttcctattgagatgaacctggtacctcagatggaaatgcagaaatcactggtcttctgcatctctcaccctgggagctgtagactggagctgttcctattcggccatcttctaatagtctctttccagtgctatctctgtgtctagctaagaaaataggtctcttcctagaaaattgcttttaatgaaggagaggtatgaggtaaaagtagggacattttgctgtcaggcagagcttgagttggatgtataaaaaaagagctggaatagtttttcccttattgccactttccatttacatttgttcccaccattcaattattctttttaaaaaggctagaggaagtgatggaaaaactgaagataataaagacacaaaatgctgaggatggatatttgtgaaaatacataatagcaaccaattgtggggcaggagggaagtcagagaacgctggggtctgtctctcctactctgccacagcatttttgaagcagcatttagtaatttctgcacagggggtgccatacttagacaactccttatgatttttcaatttctcattatcttcaagaagtgttccagaaaagaatctagaaggaacactatcaaagataatgggttacagttttccacaatgggtaaatagcctgagttttcagattaaagaatcacactgaatattgagtgatgatgtggtttggctgtgtacccacccaaatctcatcttgaatccccgtgtgttgtgggaggttcctggtgggaagtaattaagttgtgggggcaggtctttccgatgctgttctcatgatagtgaataagtctcacaagatatgatggttttatacaggggagtttccctgcacaagctctcttctcttgtctgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccatttcagactttgctaagctagtcttcctgagaaatgtcctaatttttactcaccaattgtctgtggatacctctgttttgcacaccatggtcaattcatattcatttaaatatatttaataatttgatttataatgtgtttcttatgcatttaaatatatttaataatttgatttttaatgtgtatctcttatataataatgattttgagcataataaaatagattactctttctttcttgttccaacatttgattcttgcattagctacaaaaagttagttgagattatttctcagcaatgtagagctactttgctgaaagactgctgtatctttttaaaaacttaatccaaagaaaccaatagatcataagaaataaccaaatataaagtatctgtctaaccaatagacaaacctaattagaatactgcctgcatgcttatgtaagtgttggcattcagaaaacaataccccaaagtatgttgctttggcatgctgagcagtttaaactaaaagagattgaagtcacctcagatataaaatctttctcccatctcctgctctcctgtcttctgctcctctttctccctcaaagaaagtcatagaaaccagagttcctcttatgcaaggtgaggcataaaaactagaacccagtccaggcaggttggctcacacctgtaatcccagaacttggggaggtcaagatgggaagatcactggagactaggagttcaaggctgcagtgagctatgatcacatgactgcactccagcctagataacagagcaagatcctgtctcagaaaagcagaagcagaagcagaagaaggagaaggagaagaagaagaagaagaaggagaagaagaagaggaggaagaagaagaaggaagaagaaggaagaagaaggaagaagaagaagaagaggaaaagaagaagaagaaggaagaagaggaagaagaagaaagaagaagaaggaagaagaagaggaagaagaagaagaagaggaagaggaggaaaaggaagaaggaggaagaagaagtgaaggaagaagaagaggaagaagaaagaaggaagaagaagaaggaagaagaagaagaaggaagaagaagaggaagaagaagaaaaagaaagaagaaagaagaagaagaagaagaagaagaagagaagaaggaagaaagaagaaaagaagaacctgcaactcttctgccccaaagcaagtggtgaaacatagaaaggtcactggtatggtttggctcttttctccacccaaatctcatcttgaattttactcccgtaattcccacatattgtgggagggacccagtgggagataatttgaatcctggtggtggtttcccccatactattcttgtggtagtgaataagtctcataagatctgataggttcatcagggatttttgttttgcatctttctcattttatcttgctgccaccatgtaagaagtgcctttcacctcctgccattattctgagatctccccagccgtctgtaactgtaagtccaattaaacctcttgttctccccattctcagttatgtctttatcagcaacatgaaaacggactaatacagtcactttctccattttcttgtctcccttgaggatcctcattccggaggggtcctgccccatacctgggaggaaggagtgctatacagagaggccaagatgaatctgaagagaggcctcactgagtccttcttcagtcgatcaccgttagaccaatcccttttgttcaatcatatttctgtctttcttttttttttttttttaaatcaagacagagtttcgctcttgtcgcccaggctggagtgcagtggcacaatcttgcctcactgcaacctctgcctcctgggttcaaacaattctcctgccccagcctcctgagtagctgggattacaggcgcccgccaccatgctcggctaattttttgtgtttttagtagagctggggttttaccatgttggccaggctgttcttgaactcctgacatcaggtaatcctcctgcctcagcttcccaaagtgctgggattataagcatgaaccaccacgcccagcctgtttaatcagatttctatagagctgtccattcttcactaaaccaaagcataaatgcaatttttcctgagtctttgagtttttatttctgacagcttccctgtcacataaaactttgatttgaaaaatttggtaagcttttatcttcctaatctgtcttttgctataagagtatgactgtgattcttatcatgggtgaggaaaggtatcacatctttccactcctacataaggtatgatatacattttcctctttggtaaacaaaatttccgaaagacaagcaaatggactgtaatgatattctatgactataccacttgggagcaaagttggccatataggaaaggctgaatattaggatttattaaatttatttttaagtgttttaattctgtggaataattggtgtttaggcaatttatataccttatattaatcactcataaatctcctagaaaattaattttattagacaaactttataaaggaggaaagagtaattaaaatactattaatgaaaaggatcaagtgaacaagataagcaaactttgtttcctctgccccaagtcaaactaaaatattctgtgttataaaaagagtataggggagggaaaattttctttatcttgtatccatattaggttcatcagggctctagacagagaaaaggcagattaacaagagaaaaataaacagaactttattgacacatgcatcactcttacctgtgagagcactcagtgatgcgagcactcagtgatgagtgatgatggttagaacctaagcttataaagcatcttagcaaaacaatcattgttgtgtagggaaatgacaagacaaaagaaaaggattttgagcttctaggggcagcatgttgtgggaaggcaaatatgtaaggaaactaaccatagataatggtcagttaataaagtttcttttgttgattcctctgctgctatctcaagttgataagggtctaaagttgtctcaagagattagcttctatccttcctggtagagagaggaggggggcgctgttacacatctgtctcttctttggcaaagaggaaggacagaggttttccttaaatatgctgcttctcaatttcattcctctcacaataatccttatgccaaagtggcatatttcgggggtgacatatattgttaccctttaataaattcatgctgcaatatgtttataataatcagtacatatttgttcattactttttaagtactcagtaaaaaaaaaaaaaactgtaagaatattaaaatatgaagggcaaaatgcctccctttaaagagtgctaaattcagctgtggagctaaacatatatatcttaagatatgtcagtatgtatctttcttttccgttttgaatgaaaaatttcaacatatgatgaagtagagagggatgagatgagatctctgcaggtcctgggtctgtggtgcttatgaacattttcctcctttgcctggcccttctgtgctctgaggagggggaggctgaccccttcacctgtgtttttcagcaccacccccacacttgtttctagcaatagaaggctccaatggagatgggggtgagggggcaagagaatccttagcgtgtttctccctctgtttcagagcttttagcttcaaacaacatgttaacatctggccttagttgctacaacaacttatttttagttttagttttcctttaacaattgaaaagaaattacagagatttactataaatttctcagtaggcatctggaaaaaaattaagatattgtcctcataaccaaactattattatcatatcaaagcaaagtagcaggatttcctttgaactctgttttagttttttaaaattcctaactctcctacaattctgtttataattgatatatttgaatcccagtctaaagaaagtaaagatcccagtcacattgaagtatattttatgcaattggtacattcttattttaaaataatgttattgtttatctgaaattcaaacttaattgggtatgtaatgtttttattcattagatttaggagtcatagccatgtttcacttggttattgtgcttttataggtcataggtaaaatacaagccctgggtcagtggctaaaggtaaatatgatgagctaatgaagctcacattataatttactggagctcacgttataattgatggtaataaacaggcaatacacaattaaatcaacaatatgttgataagtgctgtaaacagagaaaaaaaagtagatgtgacaatggtaaatgtgcactgggaggtcagggacaacttctctggtgaccaagtgacattgccctgacagctaacttacagaaagcacctacacatgtgcaaatattatgcttcaccttcaaaggttaaaaaatatatatgacgtaaagtttctatgaaagccaaattataggtcacatcactttttcattctcagaagaagcgattgaaaatgtaaaccccgtgaggtgggaatgcatgtagtctactcagcaaatgtaaaaaactgaatataagattttgatttgtagggtatcttgagtaaactagaagggtattttgagataaagtcaaagaggtagataggtgccatgttatttaaaggcttttatgacataaggtggaaattggattttattctacgcgtgctgagaagcttaaatataggagaattagatgaaactgattcctcttgcaggagagccacctggctgcagaagattgtcagagatcaagggtaggagccttgggctggttagcagggcatgattatagtaagtcaggtgagagatgtaggtggttcccaccagagttgtagcagtggagatagaagagggatggatttggaatgctgcttggacaaatacttcctggccctctagggtgattcaactagctctgcttgctttttctttatatttgcaaaagaattgtgagtgaacttgtatcacaacatctaaaatgctatattaactttcctgattatgttgtttttttctcctactagactataaaccccttgatgacaaaaatagtgtgcatttcacagcatcttgctcatattcagtgctcagtgcattctggagaggaagtaatttaatgagattttagtttacattccacaaagaatttccaatgaatgtggcttctacaatcctgttaattaaaaggattgcaacaatagtccaaaaaatacacatgatatgtaatctggctattatagaaactttaaacgctattcttttaactttgaaggttaagcttggttcaagagctgcctggaatcacagcaaaagtaataaaacacacaagtttttagcctctttaagggaaaatacatataacttctccaactttcctttaccaaatcatatgactgatattgaactattcttttctcctttgctgcttttgcaatcaaaaccactcccattatcttggtaaagaatgtattctatgattccttgactcctataagcttaatgacatcagcttttaaaatgttgacagaacaaacaaagtgcacacagctgcaacattccctctgcctgcagttaggtgcttttatgcttttactaaacacacacacacacaaacacacacacacacacacacactcatactcattctacttcatttcaatttgaactacatgtggcttactacgtctcagttaatggcaagcaacataacttgttggcttttataaaagttaattattacttgtatattaatttgtttaattttgtttgcccctaaacactctgagaaggaatcattgctattttgttagattttctgctacctctcacatgagcctgatacttggatttccattttttaatgaataagtaaccgatgtaatgaactaaataataaccttgttgaacctaatgttatgaagtcaagtgtgtttgtcacccaaagaattttaagtggctggatggtgagaagagtcccgttagagtaatgcccatgaattataacacccactagcagcaaaacaacacgtgcattctagagtggctcaacctaatgcgtgaggcatttgggaaactcttgagaacatactcacaaaagagtagtattcagtttatgattatttatcttagagcctctttgtgattacttatttggtaaatatatcaatttatagaattattcaacctggcttctctataattattaattcattatttagcattcccatttgttgtaaaatactctctactcttccctgaaactgagttattacgttaaggctcattgatattttattcctcataggcaggatcgtgagggcattaggaagaacttgggtatttctttgttagagatggacaaagtagttctatatacaacaaggttatttgctggacccagccctacattacattgtatgatttttgcctcgtcagctcttattacagtgactatccccttgtagagagatactcaagtattatttgttgtaacttgaatgaagaaacagcacttgagttggaaataggaaaaaggcaactcttcacagtttgtgtttatgtgcccagaaatgcttgttgactacacacaaacaccatgctgaaatataatcatccaacgaaataaagctaagctgagataattaccactgggatatttttagtcaataataattatatgttaaccaactggtattttctgccaaacgagagatggcatttctgttgatgacacgttgcatgtgttctttctacagctgtatcttcatgagtcaacaggctttctctaagtctctctgcaataggaattaacaatcagaccatcttgctcttttttttattgccctttttgctccacttgatgtaaacagggatactggccatttcttaaatgatttttatttttctactatttttctcagcataccaattttcccttcaatactcaagtttaacgttgagagagaaatgaattttgcccccctcaaagcctctgtttacatttagttaatgagataatttgtttaaaggctaaataccattactcatatgctaaagtttcacaccatgtagaaagtttatagaaacacattaaactgaatgccaaaactatctagacctcactaaaaattgggatctatgtgcctcattttagtgaagaagtttgaattaagagagatcacatcactctctctgacatccagggtgaagtctcagcattatggactccatcctcaccgtcatcttgtactagttaacttttccctaactggtaacctacacataagaatattgcactttttcattatgactgacagagatcctagtattggtgtatggagactattagataaaaatcttggcattaaaagcaggagaaggaatatggaaaaatgcagagctgtcaagaaggctaatgcatataggttttaagaaccacatgaaggtactacttttggaacacagtggaaatcaaatgcatgacttatcaacataatcatttttggatagtatgcactacttgaacatatttaactaatccaaagtcttccaaggcttggatatacactggtagaatgatgattaacaacaggacttatatctgtgctttcttatgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactttgatatcatattaatagaaaactctctaaaatatcagccttaacataaattgttgaactgcattttagagttcttactttttcattttttaattcttatatttcacaaataaagatgtatgctttcattaaaacgtgtatacataattacactcatcctcttaatatcacatatatataactaatatttttaagagcataagtggaaaacatgcaaaaccaagtgaatataatttatataggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtctcaaaaaaaaaaaaaaatctatatgtgaatagataagattaaataaaatatatctaatgctaataaatgaaactggtaaaaattgaacagcttatcaaagtctgaatgaccatcgaatgttttagtggtagactagaaactgaagccaccttccacttctgcagaaccatgacaaactgggatagaacccatggtcttttagcctttgaattccagttgctcttagaagttccatatcaggataaattgaggtatgaggagaaaggattgtattaaattcattaagggccaatacagttttctggctctgggaaccattgtgtattctcagagaagaagagagagagcattggaacttgttactttctctactacacagctcatagaaggcagaaatttatttgtttttgcataactacagaactcattaaagaggtagatcaaattttcagacttgatctgtctagggtggtttctaggagtggcaaattataagctggtataccaagcatgaattggagttggctaggccaagtaagggatggtgatacattagggtacttggacagatgaaatagcacatatggaggtccatagatgaaacaatgaagtgtaatctaggacctgaaagaactttgtagttagttgaatgtatacattgaggtcattatataggggagatgaagattggtgccatgaagtgagataaaaattatgcagagattgaattatgcagtttcatcagagattggaaaattatgcagagattgaattatgccgttcatcaaatatataaagaaatttggaatcgattctaaaaactaggaggatacaacaaagtgttttaagtgagactgatgtaatcagattttcatttttttaaacttggatttgaaactagtagagccttagtgtcttagatcctcttaacaatgaaggacaacagtttattcacagacattttaaataagaatgcagatccccaaagaattgaaatgacttacatcacattcctcctaaaaatgtcagtaaaaagattgataaagcccaggtttctgttcttggaggtattcttttgagaatgtgagagatgttaaaattcttttttttaattagaaaatcacattctattataggctgctacatgtaatcaacctcaccaaaaaaaaaaaaaagaaaaaaaaagaaagggaaagcattactgaatgctacctgtcccaaacattagtgaaactgatggataacattttttaaaagtatttatcccagcataatacaattttctattatgagagcgaggtatagaattaaagcaactatcaaaatagcccatatcagatgcaatctttaccctgaataacaagactattaaaggataggagtctaaccaaagggacttttaaaagtgtctgtcatttgctgatggtggcacagattttattactctacaggtcagagggccacgtatttctctgtttatagtgaggtgggttttttttaatagtacatttatctttcttgaatatgggaaatccatacatagttactgtgttagaattcctcactaagaataattctcgataatcaacgctatcaggagttgagggtggcataagagagttcaagaataagatgataatttgatgatggaaaaataagtgagttctcctaatgcatacctcctatcattgtagacaaaagtttatgttctcaaagctgttttcacgtactacactcttcacctctatgtgatttgtttgctagagctgctgtaagaaaattccagagactgggtggcttaaatgaatgaaatgtattttctcatggtctgggtcccggaagtttatgatcagggtgctggcagcactggtgccctctgagcctgtcttcttggcttgcagacccccactcttctgcctctccccatggtcctgcctccgtgcatgtgcaccccagtatctctttttacgtgtataaatttcctcttcttataaggatgccagtcagactggattaatttccaccctaatgacctaattttaacttaatttctctttaaagattctgtctccaaacacagttacattttgaggcagtaggtttagagctttgacatgtgggtttcagaaggacacagttcatcccataataacctccaaagacgtcaatgctaaacagcctccatgagcttattaccaactcaaaaacatcgctttcttcccaggccttccctgtttgttttacttgactgattaatgtatgctgctctttgaagctcagtttctttctccagtgaagacctactgttttcccaccttcttctctaactcctactttgcactggtttacaactcagctcacaatattcccaagttactttatcagtaaaatgttttcaatagatgaaactcatagcaagtcaatacaccattttccacttaaatttgcattattttacattggattctaattgatccatacagctcgattgtctccccatctagtttgcagttgatgagaatgggaatgacacattatatttattttgtatcttcatatgtgttgctgtacatactatatacaatgatagagtgctgtgtatatattatattctcaaatgattcaatttgattcaatttctgatagtgaaatacccagctacctgattctgctggttttcaatgttactttaattggcgtgaatttccagcaattagctttccttcaccatacatactttataaccctctagactgctcaagttggctgggcctggtcttcctgacccagaccattggatgtttaagatcacattccaggcatgaggatggctgcacatctattacctcacagattgtcaagcttgattattactgatgtggatgattatctaggtgtccttatacctcagtgttccccctgtgccttttcaagaagagtattttacccagtacagaacttttttagaaatcaaggttatacaagcaactgtgctcatttgtgatcatcttgaaatccgtaaatactgtccgagtatattactatgttaggtgaaagatttgtgttgctctccacaaattatcaatgtttgtttacagaacatttgtgaaaaataatgtttggaaatgacttgctacgtgaagtaagtaaccagtaactcaagccatttctcccatgtggtctgttttaaaaatggaaattctgtaatctggcttcctcaccttggagtaatatacaaaatgtcaaaatgagaaaagggaccttggtagttgttgtgtctttcttgtttattctttcttgttaaatactcaaagaaagaaaaacagcatgcaatgtttgtagctcccattgtgttagctttttactgtcctgacatatgtcctaaagtttaaaaagcaataaaaggttgctgcttccacagtcattagctttcgttgctgcagtcaatcatccacagaggtcagagccgtatcagtttttcccatcctcattgcacaatccactctagccattgcactcatatatcattaaaggaaaaacgaaccaaggaaactaccgagactcaaaaatgaacttgcaatgtgaaaaatctcctatctccttatttgaggaaagatgctcctgtcacgctgagtaaacaataaaattataaggccaacactgtaaatggaagtattatcccatctattgatttataatgggttaattaattttcaagtgttcttatttgcaaaacatgatgtgaacattgacagaaatccttagatagtttaagatgaagtcacttttgtcttagtgacttgatcacttatacttaggccatagttaagaatctaataggattatttcagcagagtgttgccagattcatgtataaagtcaagaagtaaaagaaaaatataagttagtcatgtttgagttgggtgatgtaacctggaaacaaatctgactggactaataataacaagttaataaactcactgtgaacaaatcaattaaaaacctaggcattgttatatttatttgcatcttactgtctaactagactttagttgaaccacacttcatttcattttaattcaagcactcattgataatatattttgcatttcttagataatttcaaaaaaagatagtgtgccatagtcatattattataagggactagagttatattctaagtcttctgacattcaataaaattgttataattgggttagacatatatgaattacaaaacatgggtttgaaagtggtcacccaagcatgattaggaaaactgcatacaagtagtcttactaaatacaagttgtaccactccttgcttcatccctcagaaagaggcatgatgttgtcactgctgctcatcttcagcttccactttagtttctgactaattctgccctagcattttcttcctgtgcttttggctgtgattttccggttacttgaatttcttgtctgccttctttgagctagaattttcaggtttagtgtttgtattgttctgactttgtgtttgggaagactgctgccacaagtatgtcccggtgtatgtaattatattcttgaccaatgctccttgtctctgtccacataacctctgttgaatcccaaatgtgtacccttggcaagttgctgggtttagtgtgagagtcgatacggcaacatcacatagaaaaaatgttcacggccaatttctaatttgataatgtgatgaaatttatggatgctttcctcattaagatgttcatcacacaaacagctgcatataatttaaagacatattcatgcatatgaacttaaaaactcatggtttagaggtgtttttaatgcatttccctggagtttttcattgtatatgacttttttttttttccttcttttgtcccttggttatattaagctgcctcttaatacttagaaaagcagtgcttaagaaattggaatatctctttccataaatatgtgataaaatgtattgtaacttatatgatttattaaattgagtcacgcctgaagcaaatgcattattaagtagttaaaaaattcatgacatgtccttaacacactgagagtgccttagaggagttcattcatctgataaatatgtgtttaagaaaattgcttgaaatgaatctcttttatgagttttggtaattattgttcttatttaagacttagatatatatagcataaataacagaatgtgtttttcacatagggttgtggtttgtttttgaatgcaaatagtcagtcttttcttggtgggtatataataaaatgctttttttgcatcattaaaagttctcaatagtctatggtgtcctagaacatattatctacattgtatataactatgtttctgttttgagatttaaaggaacatatgcaatagcaactttatatgagatttgatttttcatatcagacttcagcctcaagcatttagttgaagaatgaagatcttaaattttgacttttctgtttttagccagacatgttcaaaataaaagtgctatttaaaaagaggtctgtttccatgtcatctgaaatagggatgttttaatttatgttatagtttgagatacaccaaatcaaaggaacaagcctgcctcaataacccagtataattttcctatggctgctgtcacatagagagcacacttttttttaagttacagctttccatccctttagcacttaatcatgtagagatttgtatcgttgattatgcataaaataatttgactaaatactctgaggcagtgtcggtgacattttgttgctgttggtaccacctcttgtttcattgctactactattagtaccatcatctttgataattactacaatttactgagtgctcgcattgtttctaacatgaagaaaagggctttattttaactatgttgcagataagaaactgagatctagtgattttaaataacacacacaaaagagaagtattgggtggataattatttctgtttctttttgtaatccatgtatgcaattcaacaacacacaataataatagtataaactatgatcaaaactcttgataggctttttataatgcgatcggacaacactatttaactttctcatttattatttatctaaactatttgaataatttcaaaatattctctgcttttcaggctacttgatttgcagcccaaataatctcaaaattgtaataagtcaaggaacatttttagcccgaattattaaaaaattgctttaattttgctttagaatcaactcctcactacccattgcattttagttttatgcgtttctttatcttctattgatggactttgtaatatattaatttatatgcttaaagtcccatttagctatagttttccttttgatttaaatgtaacttaaagagaggaaggaaaatttttatttcatcacaacttcttccaagtattttataaaaattctgatggttctctttactgaacttcttctaagtgtttcataaaaattctaatggttctctttactggcttgtattagcttgtactttctttgctgtaaggaaatatatgagatggggtcatttataaagaaaaaaaggtttaattggctcatggttctgcaggctgtacaggaagcatagcagcttctgcttctggggaggtctcatgaagcctccaatcatgatggaaggtaaaaacagagcaggacgtctcatatggctggagcaggagcaagagacggggaggggtgctacacacttttaaatgatatctcatggtaaatcactcattcactatcatgagaacagcaccaagaagatggtgctaagtcattcatgaagcaccacccccatgatccaatcacttcccaccacacgccgcctccagcactgggattacaatttgacatgagatttgggcaggaacacagatccaaaccatgtcatggctgaatttaccaaatcaactgtgaatggaaagaagtgaatgaatgctagcaagtaaatgtatttcagattaaatttttttagggaactagaagtaaattgccctgtttaaaaaatgaatttataatggacttctagctttggcagcatgaagatgttgtcacattctctccaaaaagcaagtacagatgcttctagacttacaatcatgatatctacccataagtaaaaaaaaaaaaaatcttcagttcaaatatgtttaatacccttatacccaccataatatcaaaagttgtaggttgagagactgtaagtccagatgcttcctgacttacgataggattacattcagataaacccactgtagagtgaaaatgtgtatgttgaaccctagtaactcagggaccatctgtgtgatattggaaaaaaatagaaacaacatttcaaggcacatatgtcaacaaaaagcagaaaacgagttaataaaatttacttttgaaataaatgcaagagttgcaagttagaggagtatctgtggccttctttccaggtcgctgccatcttcactccccacgtcaatagagtcagcaagaatagtatttgtaacagcgggcattgaaaaccaacagtttcgaggctatgcatggggaacttcctcagtttggagtagcaagtgaaaacctatggctttgccagctaaaagtgagtacttaggtgggaacaactgagcaaaacatttgtgttagcacacagaggtcctggttgggggagcaatggaccagcaagaaagttagccaagagattctgaaaatgagcgagccatagaaggtctgagataaggtctcgcatatcactggctattagggaggcctgagagggatttgagaaacagaagctgaggaagacttgaggactcacttcaactttaagtgtgttttccaaaccactcactaataaatgtgaagtgggtagacaccttatggaaacaaagcctttgagtacatcctctatccaaataactgggtgatcactaaactatgaagacatgctggagggccaggctcattcctataatccctgagctttgggaggccaaactgggaggatcatttgaggccaggagtttgagaccagcctgggtaacatagagaagtctttccctgcaaaaacatttttttaaaatgtatctgggctagtggtgtgtgcctgtagtcctaattacttgggaggttgaagtgggaaggtcacttgagctcaggaatttgagattacggtgagctgtgatcaagctatcacactccagtccgggcgacattgtgacaccctgcctgtaaaaataaatgaatagataaatagacgcagggcagtattcctagaaaacaaggcataaaaatacaatagtaatggtaaaatacaattaagtagagtatcagtggctgggctacacatcaaagctaattttaacacacatacacagaaatataaactgcattccagagttggtatgatgcattttctaatatattaaattttcaaccacaaattatgtgatatccgaagaaacatgaaagtgtgaccaatactcaaaagagtattgagtcaatagatattgacactacatgggaccagatattggatttagcagaaaaaaaaaaattcaaaacatctactataaatattttcaaaatattgaaggagtgacatcagcaaaatggcggagtaggattcttgggcttcactctccctatagaaatccaatagcaacacaggaagtataccatcctaaatgtcccagaactcaggagtgaggctaagacttcccttggacccttggacttcaggacaaagaaaaatggaaatcaaatattaagacttcagatgtttcacctcgttgccctttctctaggccaacacagtaccatacacagagaattctcctggacccacagtttctacagttgggaaagttagttggaagcaaatcttcagttttcccaccattcaggcactctttacagaaggctcattcctattttgtcccacaggaaacattgggattacaagcaggggtggaccacctggggtcagttggcaaaaaagagcatttaggagcagctttaaaaaagaatagacaaacctttaactagacttactaattacaaaagagaggttattcagtaaacaaatcagaaatgcaaggcgaggcatcacaatttacaccactaaaatacgaagaatcataagaaactattattaacaattacacaccagtacattggataacttagaagaaatggataaattcctagacacatgaaagctttgaaaacaaacacaaagaaatagaaaactcaatagagcaataatgaacacagagactgaatcagtttaaaaaaaaaaaaaagtcttccactgaggaaaagcgcaggactggacggcttcactgctacattctactaaacatttaaagaagagataataccaattctcaaaccattcaaaaaaactgaagtataaacaatgcttccaaactcattttatatcccaaactcattaccacaacaccaaaggcagacaaggacactacaaggaaaaaaaaaaaaatatatatatatatatatatatgtgtgtgtgtgtgtgtatatatatatgtatatatatgtgtgtatatatatatgtatatatatatgtgtgtgtgtatatatatatatatgtatatatatatggcaacatcattgataaagatacattttttaaatcctcaacgaaactattagcaaacccagttcaagaacacattaaaagaatcatttttcacaatcaagtgagagttattcttaggatgcaaagatggttcaaaatatgcagatcaataaatgtgatgcaccactttaacaaaatgaaaaaaaatgagaagatgcagaaaaagcatttaagaaaactcagcacccttttcttataaaaattctcaacaattaactatacggaaaaaatgtacttcagcacaatatatgacaaacacatagctagtattattcttaacagtggctagttgaaagcatttcctgtaagatcagggacaagacaacgatgctcactgtcactacttctctctttctttctttccttcttttttttttttttttttttttttttttttttttttgatacagagtctcactctgttgcccaggctggaattcagtggcataatctcagcttactgcaacctccgcctcccaggttccagcgattctcctgcctcagcctccagagtagctgggactacaggcacctgccataacacccagctaatttttgtattttcagtagagatagggtttcactgtgttgcccattctggcctctaactcctaacctcaagtgatccatccacctgcttcagcctcccaaagtgctgagattataggcatgagccaccgtgcctggccacaccacttctctttgataaagtactagaaatcagagccagagcagttaggcaataaaacaaaataaaaggcatactaataggagagaaaaaagtgaaattgtttctctttgttgataagatgatcttatgtgtaaaacaccttaaagacatcataaaaaaactattagaactgatcaatgaatgcactagagttgcaacattcaaaattaatgtgcaaaaatcagtagcttttctatattgcaataatggtctatcttaaaaggaaattttttaaaaaatctcatttacaatagcaataaaaaagttaaatatataggtgtaaatttaactgtaaaatacctgagtattagaccattcccacattgctataaaaatatattagactaggtaatttataaagaaaagaggtttaatgggttcacgcttctacaggctgtacgtaaagcatgatgctggcatctgcttgcttttggggaggcctcagaaaacttacaatcatggtggaaggcaaagggggagcaagaatgtcacatgatcaaagcagcagaagtgggaggtaccacatacttttaaatgaccacatctcataaaaacactcactattgcaaggacagtataaacaggatggtcctactcatgagaaatctgttcccataattcaatcacctctaaccaggccccatctccaacactggggactacagttcaacaggagatttaggtggggacaacatccaaactatatcaacttatatactgaaaactataaacattgaggaaagaaattcagggtaatacaaatcaatggaaagatatgccatgttcatggattagaaaaattgatattgtgaaaatgtttatgctacctgtcttcatctgttctgtgttgctattataggatacctgagactgggtaatctattttaaaaaaaaagacgtttattttggctcagcattgtggaggctggaaagtgcaacattgggaagccacatttgatcagcatctgatgagggccttttacttcatcatgacatggaagagaaatggaaggggaaggaggcacacaaaagaaaggccaaattggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacattcaaatcacagcattctatccctggctccccctataactcatgtactcacaatgaaaaatgttttcaacccatttcaatagtacccaaatcttaacttattctagcactaaggcaaaagtctaaagtccaaagcttcatctgggactcaaggcaaagtccttccagctataagcctgtaaaataaaaaataaatgtattttctaaatacaatggtggaacaggcataagatgagtattctccttccaaaagggagagagaggcaaaaagaaaaatcagcccaaagtaagcctgaagcccagcagggtagacattaaatcttaaagctcagaatattcttgtacttcatgtaccttttcctgggcacactggggtagaggaggggcttcaagacctcggacaggcccacctccaagactttgctgggtgtagcccgtgtggctactgtcatggattggggttgcatgctggtgcctgcagatttcctaggctggtgtcgcatgttgctgatgacttctgtgggtctggagtccagagggaagtggccctgctcccatggttccactgggcattctagagaagactctctgtgctgactctgccactgtgacagatttctgcctgagctcctaggcagtttgacaaaaactttgaaatctagttggaggctgctgcacctcctccactcttgcattctgcctgcatgcggaattagcaccatatggatgtggatattgccaaggcttacgacttttgccttttgaagctgcggcatgagctgtacctgggatcccttgaaccatggctggaacagccagagcagctgggatgcatggagcagagaatcctgaggagtgtgcttgaggcctatcccccacaacattccacccttggagacctctgggcctaagataggagaaacagcctggaagatctttgaaatgcctttggggtctttttcccactgtcctgataaatggcctctggctttgttctcttcacactaatctatttagtgaagagttgctgtaccgcacccttggcttttcttctgaaaacagttttattctctaccacatggtcaagcaataaattgaccaaatcttttcactctacttcccttctttctagcagttcactagcagttagaagtaaccaggcagcagcctgaacatttgctgcttagatatgtctacaaagccctaggacagggacacaatatgatcaagttctctgctaatgtctaacaaagatggcctttacaccagttcccagtaagatagtcctatttccatctgaggtctcatctgaatggcttttactgttaatatttctgtcagcattctggtcatgacaactgaaccaatctctaagaagttttaaacatttttttagtcttttttgtcttcttttgagccctcattatattatccttaatgctccacatacagaaatactatttataatagaatattattctacttaaatgataggtaagggaggtgatggatatggtaactaacttgtttaaaagagaaagatatgactatgtgctgtctataagagatgagactaactttagattgaaatataaaaataggttataagtaacttgatttaaaaatctgtaccatacaaacataaccataagagagttagagaggctatattaaaatcagacaaaaacatattttaaactaaggtatattactagttataaagagggatcttttaattaaaaaaaggtcaacacggaaggaaaagataacaattataaaggtacttaacactagagctttacaatatatgaagtaaaatctgacaaaattgaaaaaacagaaatggacatttcaacaaatataattgtgatttcaacacccttttcttaattgatagagaaagaacagactaaataagtaaagatacaacaaacatgaaaaatactattgttgtagaaaaaaccgggttcttgtcacacgaccagaaaatattaggcatgcagacactttgaagagtgacggggagtggaatttattggatgaaaataaaaaaaaccctgtcagcaaagcgagaggggttcctgttaacaggtctcaacctcacagatcgaatcccaggtcaccacccaggaacagaagaggccaggctccttcgccctggaaacagggcgaacttcctgagcctctaccctgtctctgcagtgcgcaggtgggcattattcagaaataatcagtcaggaaaagggaaggcttcatctgggacaggcagcctggtttctcagccttcaggctgtttcagccttcagcctcaggcggggttttgccaggggacccttggctgcctcctgtctctatcattccccctcgaaaggagcacatctaactgcccttagaataaggataaggataaacacgaagaccaatcttaactgcttcctgaagacagagggggctgctttggggaaatggcagtcagatctccctcagaggccaatctaagcgttcctggcaaaaggggccattgtccaaggctctgtttgcatgaccatttggagtctgctggcctgaaggagagaagggacaaaccaggttattagaaaacatgtatccaaatgaaacaaggggtgggtgaggacagctcaaaaacccgaggtcttttacgggtgtgtacatggagagggaggctgaaagcccactggaaaaaaaaaaatacttttacctttttgccagcgtgttaggcttctgggtccccttcccctgagcccagtcctaagccaaccagtttaaggtttgtgaaattaactcttcccagtttggaggatgcatatgacgggagcgtcccagagtatggacacacaattacctatcagtgaagagaggacagaggaggaaaaaggaaaaaaaaagtagtcattttttttcaaaggattcctagggatttaggatgcattcaaaaggggtacagactgaagatgaatggctactcatctagaatgaggagagcaagcgtccctgattcctttctctttctagcaaatacatgcggtacgtgagggagggaaaatgaagcattcctctttctttcccccattcttgtatctcccagtctcggtgaccacgacagggtgccatccatgggtgttaaagtggctttcaaccatgttcacaaggggacttaggtgataggagtatctgctcttacccacatatgccccatctcccctgctgtcagtaaactttgacaggaacaggaactttcccaggaacaggagaggccaggctcctccgccctgcaaatggtacagacttcctgaggctccaccccaatctcccagtgcgcaggcgggcattattcagaaagaatcagctgggaaaagggcaggcttcatctgggatgggcagcccagtttttcagccttcaggctgttttagtcttgaaggtgggcttttgctgggggacctttggctgcctcctgtctctgtcactatcaaccaactggatctagttgacatctataaaatattttacacaactgtaaaatatacattactttcaggcatacgtgtaacactctcaaagggaccatatgctaagcattaacaaatgtctcaatatacatgaaaggactgaaatcatataaagtatattctctgatcccaatacaattctattaggaatcaacaacaaaatgaatagttggaacatcttcaaaatttgaaaattaatcataaagttataagcccattggtctaagacaaccttttgagagatattaaaaaaatcatatgaataaagatggaaacacaaaattgaaaagctgatggaatgtgggtaagctagtgcttagtgagaactatagcttttagccttaattttaaaaaacataaaaaatttaatgttaagaatgtaagattctctccaaaaaactaaagacacacagatcaaatccaaagtaattagaagtaaataaatagtagatctctgagtgaaaagaatgaaaaagaaagtagaaaaggagaaaaacagtaactaaaatttgtccatttttaaagataaaggaaggaaaacaaaaaaaaatactgatagacttttaattagattgaccaagaaataatgagagaagaaacaaattatcaaattgggaatgtgaaaggattctcactatagaaactgtagaaatttataatgtaggactataaacggaacattatgaactactttattccaataactgtgaaaaacctaggtgaaatggataaatttgtgaaagacacaaattaccaaaacaaactcaacaaaaacagaaaatagtgagatctatatcaaaaaaatgaattattaggagacaaatgtgtaaaactgacaaaatttttgaagtcactttactaaagatcacatatgaacagcatatacaaatggccaacaaaagtgaaaattgcccaacatcactaatgattagggaaatgcaaagcaaaaccacatgcgataccaacttacttctgcaagaatgaccataatttaaaaattaaaaaataatagacattggcatagatcttgtgaatcaggaacgcttttacactgctagtggaaatgtaaactactataaccactacggaaaacagtatagagattctttaaagaactaaaaatagatctaccatttgatccagcaatcccactattgcatatctatcaagaggaaaaaccgtcattaaatgaaaaacacacatgcatgcacatgtttatagcagcacaatttgcaattgcaaaaatgtggaaccaccctaaatgtccttcgaccaacaagtggataaagaaatgtggtatgtgtatataccatggaatactactaagccataaaaagaaacaaaataataacattcacagcaacctggatggaaatgaagaccactattctaagtgaagtaactcgggattggaaaactcaacatcgtgtgttctcacatataagcaggagctaatctatgaggatacaaaggcataagaacgatataatgttttgggttttacatttaagtcttcaattcatcttgagttaatttttgtataaggtgtaaggaaggaatccagtttcaattttctgcatatagctagccagatctcccagccccattgattaaatagggaatctgtgtatatatccaaaggaatataaattattctgttataaagatacgtgcatgcatatgttcattgcagcactactcacaatagcaaagacatgaaatcaactcaaatgcccatcaatgatagactggattaagaaaacgtaatacatatacatcatagaatactatgcacccataaaaaggaatgagatcgcgccctttgcagggacacggatggagctggaagccattattctcagcagactaatgcaggaacaaaaaccaagcacccatgttctcagttataagtgggagctgaacgataagaacacatggacacagggaggggaacaacacacactggggcctgtttaggtgtgaaggggagagcatgaggaagaacacctaatggatgttgggctgaatacctagatgatgagttgatctatgcagcaaaccaccatggcacacgttaacctgtgtaacaaacctgcacatgcacctggcacttaaaagctgaaggaaaaagacaaaaagaatgatataatggactgaggactggagaagtgtgggaggaaggtgagggataaaagactacacattgggtgcagtttacactgctcaagtgatgtgtgcaccaaaatctcctaaatcaccactaaacaacttatccatgtaaccaaaaccacctgttccctaaaatctatttaaataataataattaaaatcacataattcttatagtaatttaaacatcattttaatagttctatatcacttgtattgatattttgatataaaattagactaatttgtctttcattttttaatgttttcacttcttttttagttacattttttaatttgtaaaacttttctgtggttaaaatatcaagagccgtagtatgaaaaataaatatacatagaaaagacttactttaggggctgggcgcagtagctcatgcctgtaatcccagcactttgggaggccgaggtggtgggtggattatgagatcaggggttcgagaccagcctggccagcatggtgaaaccctgtctctactaaaaatataaaacattagccgggcatggtggcgcatgcctgtagtctcagctacttgggaggctgagacaggagaattgcttgaaccgggcaggcggaggttgcagtgagccgagattgctccactgcacttcagtctgggcaacagagtgagactccgtctcaaaaaaaaaggagagaaaaaaaagaaaacactcactttaattctgtccattgttgaatgatggctgctcaaaattgtagaacaactggtttattgggaaaaaaaattgtctgtatttgcatcttggtcaaggactatattaccttgataaagtcttagtaaagtattgaaagggggagggaaaattggggtatttatgaagctttggaatatgatttaaagaagttcttttatgagagagtttcattacggagaagcaaggattttaatgatttacatttggttgaggtggcaaggtgaacattttgagaagccttagaaagacttggggagtaagctgtcattttatgccttctattgaagagctgaacaatttgctctttattgaaataagattttcagaaagttcctggaatgaaaagttatttgcaactattatcttcttgggcaagtttcctgcgattataaagtcatgttgacacacatgtagtggaatggttaaatcatgaaaatgtggacagtatgctgtgtgggggtggatggttttggttctcatgttccaccatgattctctctgttccttaacagtgtaatttttgctagtttattcattttccatctggtgtttactttttaagaaagcaattgcaggtatagccattgcttttcagacatttattaatgcttaccacacatttacaggaacaactactgtgaaccatgcatggtgctaggttttaaagattaaaatgatttaaggggaaatgagattttcctccaaaataaaaaaacttactctaacttccagatttaattgctaagcacacataattgcacctaaaacaggttgatgagggattgatgagggagagtatagagaagcgcctgtgtggcaactctgttcacatttaattaactgtctatagatggctgctaccagcattgatcaaatgactacctatacatattttactcttacacaggaaaaaattaaattggatcatgatataatatttatataactttttaccacccatgttttaagatataaattctagattaatggagaatacatcaattttaggcaattttactaagaagagcagatattgaagaacaaaaagaaacactctgtaaatacaggtgtctactcgaaggttcatcgaaatttaaatttgttgtgaattcttcacaatgagacttttcattttcattagaattcttgcagcattattattccaggattggaatacagttgcatatgataatctttgtttcctttataataactatgagtgactcagttaggaattcaccttggcacaggactaagttatttctgatctactcaatggagtgtatgtatttaggattattcatccttgtttacttaatgtggttttcttcacacattgttttttagatgtcgtttgagagaaacaaaacctttaactcttactgagagggaagatgaattttctaaccctgggatttggctgctcactgagtgtacacataatagatgggtgcttccattgtattattaggggcattcagtagagggcctctcatctaccagggcacaattgagtattcctgattattgatttgtttatttgtgtttatatatttgtaattcccctttaaatactaatattatcaagtgttctaccacatgtgatttccctgttctgagctgtctaacattaagtataatggccaaaccccattttctgtgggatttgggattcttgacctaaggaccacccagcaccatgcccctgagacctcccatcctgaacacagctaatcggactggagaagtccatctgaggaagaggaagcagttgtcttctgtagtctgaccaggagattagcaagaagtctggcccaaaaactctgccccacaggtttctctaccaaatggtgaaggccaggtgttcagttactttttcctaaggtgttgaaacgtaaagcatgtggaaaacatgcaaatagaaacagcaaaatggaagcaaacagagaccatgaatcagtaaaatccatgaaattaagggaagtgaaaatcaaagtcggaaaatagtggcagccgctccacagtagtggagcatgagggtaggttatcttcaagtagtgaggtttgtgtaaattagatttctttatattttctctactttttaatgctctgcaatttaaaaaaatgttacttttgtcatcaggataatatgttcaaatttttaaaaagtacctaaaattttaaaaaatcactagcttgatttaactagattttcctttgtttatcatcatgactctgcaaaagctgcagcatctgctgctttatgaatgaagtgctgattaggcaagcaaaaatacagttttccagacctcacatttaggcaactgttaaaagcctagtttccgagtcaaagccagatataaatttctaccctgtgtctcaactcagggccagttatggatggtggagagtttgagatactagtggttaagtttaatttcagctgcctgtgtttgtaaccatttgactttatctaaggaaggcaattctacaccttctctcaataattttttttttccacttggttttctctgacataactgagatcattgacattctgactagagcctaagaaatttcatgtatgtgtctgattcagtggttcaaggccttaaagataagcctttaattctgaggaagagcctttagcttctcccgtctcttaatacaaacctgattcatgccaggtttgtctaggggctacgtggatggttaataaaaacatgtaatttctatcccccaaattgtacctatttaggattagatttcagaatcttatttgaaacttaaacaggctttagaaataattttgtcccactctattattatagagatgaataaatgtactttcaaggcaagtagagcgacttgccaagattacaaaaaaatgtctgcgacagagccgagtctagatgtttatcttctagtttccagccagatactagttttatggctagtttccgccatgctctgagggaggcacattttccatcatcttttatctcaacactgaatactgtttttgacacatagtaggaaatcaattaatactatttaaatgaatacaaatacatgatgtaaaatatatcagagaagtctattatgtgttttcagacaagcttttatttctacagtgtatatttttatgaaactgatatgtatttttttagactaatgtgcaccatcaaatagcactcatttttgaaacattttgagcgtgatatgtatgtaccatcaaacggaattgagtaatatctgaagttgtactgggcactctgccaagatttgtccaaagaaagtaatgtgaaattagctttgcctttctgaatatttacaaaatccaagcaaaaaaagaaaaatccaaagggaaaatgctgatctctggaatactttggacaattcatgcatcaaaagccaactgcagagccactatttgcaagtcaagtctcaagatggtatactatctccaggaaaaggcttggaaggtaagtaagcactactgttgaccccaatatctcaatttccacggagaaaccatatttgttaagatgcagagagatctctctaaagtgctattgccgagattaaatttgagccatctgaaggcttcgtcattatcttagatcttagccttacttgtgccttattctgttctttaactatcacttatgctgcaaactgtgatcctattgtgattttacccttactaggtggttttcctggtaagataagtatttgattctgctcaaatttctcctcttgccttcctaactggtctcaatctttctttctgcttagtatcattctgtctcagcacccgtttatctggctgcgctttggccagtttcattgtttatgattatttggttttggtgcctgcctatatgatcagttcaagtcctagccgtgctggaaaatttctggccccattacagaccagacatttccactcacagctgcttctgtatctatcacaagtatgcattcatgcccatgtgcatcaatcctatatcaatagttgtttctacagagatagcctctgaagtccatccttttgtatatggtcataggtaaactgaaaatgggaagtaacaaggtctctgttaattaaaaggtccattaagggctcaatgccaaaagttggatacgggaaagcttgccaagtgcacaaggttagaaacttaattgcacttctctttaccaagatttctatcaactgcagttctcaaatatatgaccttcctttaattttgtactgatgtataaaatgaggattttgcctgtttttgtacttgccatttggaggacatatatgcatgcctgccataagtggaatttacatatgtatatgtaaaactacgattcttggctttatatcagtggaaaaataaatcagattatgtagatagatctgtctttatacctgatttgcttttatatatatatatatatatatatatatatatatatgcacacacacacatacattcatatttattttaatgggcaaaatatttgagaatatttacatgaaattttttatgtagtaatctaattttggaattgcactatttcttttgtagaactccaaaaataatcagtacacaaatttgaaagcaaaacagtaaacttgaagtcatttttggttactctatcttctcagaatactgaggtaattagactacagggtgtccttcaatacttgaaattatattttgctgtttgcaattaagatgcactgcagaatatgttgtcatggaatggccaccccaatggctgtcaagcagacatttttcttagccaagtcacacaggtaagtaacaaggtagattcaaggttgataaaaagcaaaagcaaatccacacttattggtttcctggtgtgacattgagtatactttgggatttcacagaagggttagtcagagtattccttcctatattttgatcagttgctaatacaggtttgattcctctttcaagtagaaatgactcagctataaatttatagctgcctctgtaggtagttaatgcaggtggataagcaatattgacagcatgactaagtctagccaaagcaggtgcatgaaaaattattagtccattctgcaaaaccctaggccatctattctgtaggatttatctgtcttttccattcccggtatcaagttcttaactactaaattaagcttatactgaagaggaggagctaggaaaatcttccttagatattcagatactcaatattccattaatcgattaattaaacaagaaatcaattaaatcacaatttatttgtgcacttttcatgtgacaagcatttcgctggttctgatctcacaagagataaacataagaaaccatttctgcacactgagaactcaaaggtttttgtgggagtcagaccagttatgaggctgcgttccagtttcaaaaatagcagtttatataaagagattgaaatttctgagaagattaatagaattcagacctgagaagaccgctcaagtcaagggacagtgccagaagcgagcatacccctagctgtgttatcgctgcctggtgatatcctgtgggtctttttattttataatatttcagagatgtgttctgtaactcatatatagggagtcaaattctgttatttctattcatgcctggcatataagactgatatgatcttactgttagacttttcatgaagaatggatgttagattcaggtatatatttttgaagttaaatggcccttgttacagatgtaccagagctccccaatatagaagcagttcttccaatattaattactatgtgttgtatattacaagttgccaaggtaccaatagaaaacacacaaagtcactgaatggaaaccccccaaataatgtaaaaaatatcacctcttttagctcttagaaaatgatgtcgacttctttctaaaggatattgttactggagggatgaggaaaaaactcaatttggaggaaattagaaaataatttgcagtttagaagggggttatcttatatacatgttggtaataattcaacattaacaataaatgttataataacaacatagttatcatagtaaactattttataccaaagcagtagtcccagaacttaacacatactaacttttgattcttattacagtgctatgatgtaggtatgtatgtcaccccgctttagatataagaaaaaaagaggcaaaaggagaccaagtttttccaaaatcacagctggtaagtgtcaaagcctagatcaatctagatagcctggttccaggtgccttagtcttagtcttttcaactgtatgctgcctatgaatttatgatacctcacttcttctcctatgctgtgctcatggtagtttatgttaatttttcagttaaaacatttgtcttttccaagtgtgcggtcatgccattggtctatttttataccactacctttgaacttttctccgtctgatgtatttctcttatctacatgtgtagatcattacctccagaataatagttgtagcaatgggcattgttgccctaatgggaattcttcaattgtcttccccaatatgtgtgagttggctttgaggttaagctaaatatatcttacagagctaaggtttatgtaagaaatcaacttcagaaatccagctgaaagtcagtagtgtgaagagaggtagtcagaatgtaaatcatttcaaaggtagagttgagagcatttcttgatagattggatgtgatgtgtgcaagagaaacagaggattcaaggatgactcattttttgattgtcattgtttttggtctggccagctaaaaaggagaatgtattacctactaagatgtggaaggcctgggaggagcaagttttgaagaaaggtcgagaatttatttattgctgtatgtattaatcagggttcttcagataagtagaaccaatagggtagatacgcagtgagagaagtagtgaaaggtggagaaagagagtgaagagtgagagactgagagagagagagactgttttaaaaaatggcttaagggtttgttaggatgaacaaatctaaaatttgcagagcaagccaggtacattggctcacatctgtaattctagcactttgggaagctgaggcaggaggattgcttgagcccaggagctcagggccagtctaggcaacacagcaagacctcatctcatatttatttttttttaattagctgggcatggtggtgtgtgtctgtggtcccagctacttgggagtctgaggaaggaggatcacttgagcccaggaggttgaggctgcagtgagctctgatcacaaacactgcattccagcctgggtgacagagtgagatcctgtctcacacacacagaaaaaataattaattaattaatttaaaaaactaaaaagcataaacaattaaaaaataaagaataaaataaaatttacaaagcaggccaacaggttggaaattctgacaagagttcattttgtagtctgaaggcagtctgggggcaatattcactcctcttcagtgaacctcagtcttttgtattaaggccttctaatgattgtatgaagtctacaaacaatatgaagggtaatttgtttttaccaaagtctactgattgaaatgttaatgacatctaaaaagtacctttacagcaacatctagtgtttgaccaaacaactggatgccataacctagctaagtggacatgtaaattgaccatcacagcatagtaagttttggatgcctactagacatctaagataaaatttcaaatagcctgttaaatacacacatctaaatatcaagagaggaatccaggcaagagacatacattcttggattcatcagaacacagatgtcagtgaagccttggctcctggttccgcagactgtacaagaagcatggtgtcagtatctgcatctggtgaagtctcagaaagttttcagtcatggcagaaggaaaaggggagcaggcatgtcatacagcaagagagacagcaagagagagaggggagggaggtccaagattattttataacctgatttctaatgagctagtagaggggaggactcactctttactctttactgcagggaaggcaccaagccattcatgacccaaacacctcccacaaagccccacctccaacactggggatcacatttcaacatgagacttggaggggacaaaatatccaaccagtatcaaatgctttacccaatttagcacagtgcccaatttattaaagtaagttttcaaacacttctttaaaaataggtgatatctctctattcctgatgacttaaataagatgaatcaattttaccccaaaactgtgtatgctgcttgaatgctacagaaaagaaagaactaaaatatattttaaaaatatctaaaaccattaaaatgtctcctggtgatatttaaaattagaaatagggcactacttatttaagtagtatattaataatgtgggaattggttgaatctttacctcttgtggttctggaactttccccttgcaattgtatatatctgtagatgacttacattatccttaactgagggaaaaaatgtgttatggaagtatttttgattctggttaatgcactttatataaaatgccaaacgtaaattattagaggtaaagatgaggctttgaaatttttatgaaatatttcggtccagaacttggttaacccaaatcctgtcctgctgatcatgcattctccatctggagttcctgagaggctctacatctgagtatcagagtatcactttgataatcactatttaatgtcttacagtatagtacagacctttggacaaaggatgaggtggtacaaatggagtagacacaaggcctgatgagaactttttaatttattttccccttaatgtgtgtcttactactggtataaacaagcatgcttgcaggaaggagaaagagatggctaaaacaaaatcaatttatccattatggattagagtccatgtataacagagagaaagagctattttcactatagatagcttcagatttatggctcaaaaactatgctgctggattgtgtcaaacagtttagtaaaaatgaaatattattctctcatttggcataagacatcatgttgctcgggcacaatgagtgatcctaaaaatataatatggttatagcttctgttaatcaagaatgaggtaaccagcagcttctgaaaacaaagactggtaatgatggagatctcccttgagacataaatctcatctgtgatcaaaagaagagtagccttggctcctttctggggatccctggcagccatgatttttaagacacattaacaaacaactctgtggcagcaggaacttcctgggaagacaacagtagaaggaccagagtagaagatgggggaaaatatcgaatacctaagaacacagaggaaaatatcagatactcagaaaaatatccaatgactaagaaataactcagaagacagcaggatttcactagagtagatggggatagaatctagaaatacgtaattttattgttataagatatatttcgtaatctttctccctgaaattggaagcaatgcaaacacagggctgctgcagcctctattccagaaggcaacctttctaccctgtagtgtagtggccctatttttttttttttacttctctttttccccacctttctcaattgcttttaattcaccaattatatattaaatctctaccatatgttcagtgtcaaactatatgccagtgtaaataattggtattacccttcacacatggtatgtctaggtccagaaatatacaaatatatgagtaatatgaattgtttaatattataaaatcttcctcagctgccatgttcagtggttgtaaatatactgtggaactatgaatggaaaataggtggaaacaaataaatgtatgctcagcaaattaaaaaattctaaccatgttcttactgctaagaactttctacctgcatatattcctggagtgtcaaacctgaaaatgatcttctgcaacatcagtttatttatattaatttgtatctattagacttaggaaaatagtataaaaacaggaaggaattccatgagggactaaatgaaatataaattcgtaatattttttatacctataaaaatgaggccaggtgcagtggctcatgcctgtaactccagcactttgagaagccgaggcaggcggatcacgaagtcaagagattgagaccatcctggctaacatggtgaaaccctgtctctactaaatgtacaaaaattaactggcagtggtggcatgagcctttagtctcagctactcaggaggctgaggcaggagaatcgcttgaacccgggaagcagaggttgcagtgagccgagattgctccactgcactccagcctggcgacagagcaagactccatctcaaaaaaaaaaaaaaaaaaaaaaaaaaaagcaaggatgtcaaatttgggaactattttctatttgaaactttccttctgtctctaaacaagtttaaaagcagcacccccacctctcaaatgcccttaatagacaatgtaatataaataggtactacaactcactaggtttgattcctgtagaagatgaaaagtgactgctccacggcaagccactatgggagattctttaacaaactcaaatggattcgagagggaaaattgttgatgcaaagctgtttaatgagttctgttactgtgaagtgaaatcagtcctcccaaggatcattcactgtgagaggcagaatggaaacttcctaatgtcataaattgttataccgatatttatagcaaaggcaacatagaactctggagtttgaattagtttttttctctccaagaatacatttttagtattagctgtttgtttcaacctgggaagttttagaagttatttctatctgggcattttcttagcttgacagtttaggtaagaagtctgtgtggctatgccagtagcatatctctttgtgacaagaacatgcatcattctttggctgagcaaaagacaaaattatttactcaagataagcaaagattattggaaggctgaaattgcaaatgatgaaagttctacccatagattttgtttgcccatgactttcattctgtccttgcaaataaaagaataacttgatatatttcattgaataatcacattttatatttccaatttactttattaaaatatgattttagtcctttaaataaagttgaattgagaacaaagagaaaaaaataatatccaataatgtcagttcagatattgtgggttaatttaaggatgaaataaaactatataaatttgtccatgtccccatgagtttctcagtgttttgaggttttgctcagattcatttacacatatggaaaactttttaatatctacataagggattcacattcgaagggatttcattttatccctcagtgaaatgaaatcccttcaaatgtgacttccttacaaagtctggccatagtcttgaattatcttagctgcattttctctaaagcgtcactgtccaactgaaatatactgtgaaccacaaatgtgaatatgacatttaaatagtctagtggcaacattgaaaaaataaaacaggaaaataattttaatgtgatataaacatttaatataacatatttaatatatttaatgtaaaagaagtatacttaattttaataaaataatctagttaaccaaatataaatgttaacttttcatcatgtaacgaatatataagaatgacccatgatttattttgtcttctttaaaagaggtttataatctttgcttacagatatttcagtttacactagccacatctgaagtactcaaagccaaatgtggctagaaagactattgaacagagacgctgtatggtacatattcttattagataactattatttaaggaagtagcataagaagatattttaaatgctaatttaaaattctaatgacaaagccatgttttatatgatatgtgtgaataaaacatagtcagatcttttaagtgaatgttttctttgtatatagagagagctgtttctgtctgtggaaaatttctgctgaggaaagaactaacaaatgacaaaaagaacggctttgcctgggacagtagcagaggaaactaagaaaaaggatgtcctaaaatgagttaagaaaatttttacttagaccctggacatcatagattataaaaggagcatttaatgacaaaaatatcataatgtctcaatgtacagtgaatcaatagtaccttgtgggactgttgtctgatactaattgaaacacagtatttgaaagctacagttgtttggtttgagtatgactgtcttcatcagcaagaataccttacatagtgtctgttctatttgctattttttttctattcttaacttttatgggtttatctttggcaaaagctgattttataaggagaaaatctataaattgcattcatggttatgccaaactcctcaggtacaactatcaaataccagcactttccagggaagattgtcttcaggatctgatcattcagcattttaccagaattgttgttggaatctatggagccacagtctctgttggactctatataactttcctccaacctggtcagaaccatagctaatcaagtaataagacattatgacaagaaataccccttacaaagacaaccaaaagagtcagcatccagtattgttaaaaacagttccaagtgtaaccaaatgtttttacttctcaatatttttttaaagtagcattattatatgtaaaatataagctttgtatggcagtagtttttgcattaagccagaacttactatttttcctgaaaatacttactaatgtacagaacttttttattataaaataatgattggattagaatgtatcctaatgactttcaaacatttaattttattattttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctgcagagtgtacaagcatagcacgggcatctgctcagcttctgaggaggcctcagggagcttttactcatggcaggaggtgaaaggggaggagccatgtcacatgggaaaagcaagagcaaggaagaaaggggaaggcgccacatataccaaacaactaaatctcgtgagaactgacttaataccatgagggcagcactgaactaatgagggatctgcctccatgacccaaacacctcttaccaggtgccacctccgacactggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagactctcaccaggtgccactccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctctgacgctggagatgacatttcaacatgagattctcaccaggtgccacctccgacgctggagatgacatttcaacatgagattttcaccaggtgccacttccaacacgagatgacatttcaacatgagatttgagtggggtcaaacatccaaactacatcattctgcccttggcccccacaaaattcttatgcttctcacattgttaaatacaatcatgccttcccaatagtcccccaaagtcttaactcactcaagagttaattcaaaagtccaaagtttaaaatctcatctgagacaaggcaagtcttttccacctataaacttgtagaataaaaattaacttatttacttacaagatacaatgaggttataggaatttggtaaacattcccattcccaaatggagaaatcagccaaaagaaaggggctgcaggccccatgcaagttcaaaacacagcagggtagtcattaagtcttaaagctccaaaatacactcctttgatgaaatgtcccacatacagggcacacagctgcaaggggtgggctcccagggctttgggcagctctgctcctgtgtcttttccgcactgaagtttcaagctgctgttggcaccacccgtctggagtgtggaagatggtggctcccttcccacagctccactaggcaatgtcccagctgggactctgtgtgggagttccaaccccgcatttccccatagcactaccctggtagagtttctctgtgagggctctgcccctaaagcaggcttttgcctggtaacccagcctctctcatactttctttgaaatctagggtgaggttgccaaaccttcactctcgcagggtgcatgcctacaggcttaacactacgtggaaaccaccaaggcttatggtggcttatgctctctggagtggcccaagctgtactgtgaggcctctgagcagtgactggaaccacagcagccattatgataggaggagcctcctgaggtaacactgggcagtagcactctgggcctattcccataccaccaaaaccattcagtccccctgggcctctgatgggaggggctgcctagaagatctctgaatgccttggaggcctttttctcattgtcttggctattagcacttgactcccttttagttatgcaaatttctttagtaaatgattgctgcacaacctacttgaattcttctcctaaaaatgggctttttgtttctaccccacagccaggctgcacattttccaaatttttatgctctgcttctcttttaaatataacttccaaatttaagtcatttctttgttcctgcatttgaagctggctgttagaagcagccagacaacttcttgaatgctatgctgcttagaaatttcttctgccagataccctaaatcatctctctgaagttcaaacttccacagatccttagggcatgaacagaatccagccaagatgtttgctgagggataacacacatgacatttgctccagtttccaacaagttcctcatttccatctgaaacctcagcagcctggacttcactgtccatatcactatcagaattttggtcacaactatttaagcagtctttaagaagttctaaactttccctcatcttcctgtcttcttctgaaccctccacactgttccagcctcagcccattaaccaattccaaagctgtttccacattttcagctatttttataacaatgccctatgccttggtaccaattttctgtattgggctgttcttgctttgctattagaaataccttagaccgagtaatttataaagaaaataggtttacttggctcttggttctacaggttgtacaagcatagtgcttgcgtttgcttggcttctggggaggcctcaggcagcttttactcatggcagaaggtgaagcaggagcttgcacacacatggtgagatgaggggttcaggggtaagagaggtaggggaggtgccacacacttttaaacaaccagatcttgcaacgacagcaccaagccatgaggaaaccattcagatgaccaaagcccctcctaccaggccccgcctccaacgttggtgatgttagaaatgctcgtttcccagtgccgtaaagaaatagcacttgaacataaatttaacttcctcagcaaggccatttttagactttctgcagaaaggatacactcgccagcagttttgccatgagagtatattgaacaaaggagactgggttatttataacctgatccatccactctacttctgtgtccagtttttattggctgaatcggaccttatatttagatggagaggaaagtctctttgaagaggaacctctactttactttttacagtgattacatttctagatgagatttgggcagcaacaaatattcagattatatcaggtagcgacataagaaaagtaaagggaaaagcaaaaaggagtgaagaaatgtacagaagggagaaaaaaagaaacaccgaaaaaagaaatagaaatgataaactttaaccgtaattattttagtgaataaaattttaataaataaaggagggcattttgtagttttttgctttatacatttaaggaatttttttttcctaagcttttcttactagttttaaaatatattaaaaaaaattaaaaattgtatacgtgcatctgcttttcttatttggaggctactgtaatgtttaaactgcattttatttattaatatactccttgtgtgagaaaggaggctcacaaggctatgtaaaattcaacaagctagcataaataaaatgtttggaaaaaataaatgacaaggcaatatgtgatcttaaaacagagtggtaatgaggtttaaaaatatataacattatgtccaaaaatgagattccattatgtctggcatgtaagaagagctcaaaagaagacagatttattttatgtgcttaataataaaagctaattgatgtattctagacacaatacccacagtgtcctcaggactttaaaaatctcatgcatattttacaattaaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgtgtttagaggagtgtgactggaagtggaaagacactttttatgacaagcgctaaaagaaagcagttcgttttggaggccttggaaaaagagcagggacacaggttctgcgtggtattcttttgcaaatacctgaaaccactagttgggaaataaattaaatgaattaataaactaggaactgtagtttgaagttagatggagtggatttggaaccgatttaagattttttaatgagcagatgattgatgaaattaattgtcacacaaattgatgtttgctattaatatttagctttaactgaatgaatacaaggtcagtgctcaaatattggaaatgttcctggactagacaattctaagattgctacaatgctgccagatccaccgttggactttccttaattcttattcaataattaatgaatatgaaattaatcttcataatgtaacattatgaagcacagaaacataaaaacaagtttatctgtgaatgtatcatagagaaaaatgagatttaacatttaaaacagtggataatagtaacattgaggctcctttacatctcgatagatttttaatgtctttgtccgtcaaagtattcaagtatttgtggaattcagctatgtaccagaaataaagtagatcaggtaatacaaacaaacaatttaatatatttcaggagaaaaattagaaaatattcctccttttacaacacgtataaagaaacagctaaattgataatctcaggtttttgctttgtattgaattttctacccgaaaagccttgggcagtactttttcaagaatgatgttcttttcatatttgactttaataaagacagcacattgcccgcgtccataaaatggtagatgagcaaattgctctgtgttttactgctcactcgactcctacattcatagtatttgacaagtaggacttaaatgggaacacttctttttttcttggagagggcagttactctgaaatcttaaatgaatcatattggagtaaggtgacataaatttccctcctcatttattaagatccaatctgcatgcagtactctgccagacacattatattaggttggttaaacagatatgatactagcttcttaagagaataaaaatcagatgatatcaacatagagacccagggttattattcatgacagtgccctgtgattcttcatgaactaatatagctcgcgaaagcgaagggatccaggaattctgtgataaatatgaggcagtttgtcctgaccagagatctaaagattgaaaacagtcatgagaggctttttgagagtctggaggacaagtccatgactgtaaggaggtcatggagaaacaagcaagtactgttacctgagcatcggtttgagtaacaaggagtagacgacgaagtgaaaggaccgagggataaaatgttggtgcccatggggtaagataaccatatcatgcagtcaggaatcccaacagaaactcttgcatattactaggtcaggatgcagatgagggaaaaaataaacatggactgcaagcatgaattctgatactgcagtggtgtagagatagcactacctacagcattctgcctaaagccaatgatctctgagtgggaattgacaaaaaagcaccactctttagagctttaggaatgagaatctaaaagaatttctcacatctccgctagccctcttggactctccattgtgctaatcatattcagtgctggtctctaacacttcaggggtctaaccgaatcacttttcttgtgtttgtgacccagcttgccccgaatgcacaccctttggatatcatccctccattcttggcccaatattgtcccttcactccttgtagatctgaatttaaaagtagaacaagcaggcacttgcatctgcctaaatagtcatgtgaactacattttgaacactagtgttctgaatcttcatttctgcaagatatctttaaagtgggatttggaattttgttagaattacatcagaattattgataataaggcaaataagctgctttccaagggaaacgggaaatctgtatactgtatagtgataaaaatgatgccattaaacatcgtaagttaagctctataaattacccatactccagatagaaaagcaaaccaaacagaattaacccagaaaagggatttcaaattatatagttaacatttgttttccttttttctaccctgggacttattgttatctattagtcaccttccttagaaaacatcaagtctgtggataaatacacttaatagtgttagcaggaatgctattcatgacagacctcaacatgttgactcgtactttatttaagctattatgagcttggcgaaaatctgaaagaaagacgatgcaatttattttaggaaatacttcttaaaagtaaagatttcaaatgtgggagatattcatgaatagaaagagttggttttgctctcattggttctgcttgttttgctactgtctagctatatgagggactttaggaaagccattcctaataaggtgggttttagttttctcatctgtgacattaaggaattagaaatgatcatgtaaagggaccatttccttctgttatactatagattgttattgatacacaaaatgattggttaattcaagttcaattttgttaacctgaaatattttgaattacttttgagagatccttgtttaaaagccataggcaattttgtgtgtgtgtgtgtgtgtgtgtgtgtgtgtgtgtgtgtgtcttttagctcagtggttatcaatggggcaatgttccctttcagcaggcatgaaacaatgagatattattgattgtcacagatatgggagagctactgcattgagtgggtagagactacaaatgctgctgaacgtcttctatgcacaggaaagccgtcccttaacaaataattatttggtccaaaatgtcagtagtgccaagattgagaaatcgtgcaactagttatggtccagattgatggcatacctcatccttcatgatatagtgatccaagtgccttgtcatctaaaccaaacagagcagaatctccaactctccctgccctgagaaaagggactctattttctgtcagacagtaaggattggagaccgtatttgctctcgtgcttgagagcccacatcattattgggttaacagtcatagctagagaattcagtctgtgtattttttttattagtgttattttccctttctcgtaatgtaacaatttttataaatgtttcatgggctatgaaagaagggcatttttcattttcatgccactgctttagcaatgtatagatacaatcaatattatggattgtgatttaggtgggtgttctatatatttacagtcaattaaaaaccattgaagagcttttcattgatttcattaatttctattatcttaataattctatattcaggcagggctactttagctatttgtgtgtatgtgtgtttccgtgtgtgtaaatgtataaatacatgtacatgtgtgtgtgtgcatatacatataaaatcaaaggcatacctagacctaaacaaaatattctgttctcatgatgtaattaatctcataagcaagataccattctctgtgtgacacagtttttttttctagttagaattcacattcactaaatgtttaacactctcttgatttcactttaaaaatagaacatcaggctcacatatggctgctctctacactagaactaccctcaggggtgcacaaattgaatacactcagtatttttctcctggagttttttaaaaactccatttatttccttaaacttttgagacaacagggctgatgttttctgtaatgaagttagctaaatgagctttttattgaaatttattcaataagattcattcttcatgtgtcaatcagatatcacgattaccatgctcaaatccaaattcaaatttttgttttatgagatttcctacacttctggagacttgaattctggtcttctctaacagtcattatctatttatctttaaataaataacttctgtacactgtggattgctttatttatactttggtaatagttttctgctcaatttgacccagagataggctcaggtagtaatattaagggcttctgaaaaatatcaattactatacatatatgagtaatggtggtagtataatttacacattagacagcaaagcaaatcaacaaaaactaaattaaatagggcaaaaagatgctgtggtacgaaattttctggataattttagttttagatcatgttgttaatttataattgagaatttgataaattagttcaatcttcattaccaaccatttgaaacactggctgatatcatggccaggtaaattgtgtcctttttttattaaacgtagttgactgaacacttgcttttcacacattgaattgggtcctggcaatacttggatgaatcaaattgtttccatatccttgagaaactgccagtgcaggcaaaatagggtaacagatgtaataataaatgcatgcacagcatagattggagcaaatggaagcactgacaaactcttcttttttaaaaaaaataattttcatttttttgctgatccataatgtggtacatattttggaggtacgtgtgatagtttgatgcatgtatataagatttaatgctccaattagagtaattgggatatttatcacctcaagcttgtatcttttcttggtgttgggaacgtttcagttcttctcttcttgcttctttgaaatatatttttaaaatgttaattatcatccacctactatactgtcaatcactagaacttattccttctgtccgcatttttgtaaccattaaccaacttctcttcatccctccctccccaatacccttcccagcctctgataaccaccattctaccctctatctccatgaaatccacttttttagcttccacatgagtgataaaatgcaatatttgtccttatgagattagttaatttcacttaacataatggcttctagttccatccatgtttctgcaaatgacaagattttattctttttatggctgactaatatttctatacacatgcacacatatatatatatatatatatatgtatcacatttctgtattcattcatctgttattccatatattggctattgtgtatagtgctgtaataaacctaagagtgcagatatctcttcaacatgctgatttcctttcttaggctgtgtacccagcagcgagattgaataatatggtagttttatttttagttttctggggaaggaacactatattgcttgtttttcatagtggctgtactaatttacattcccaccaacagtgtgcaacagtgtgcgagagttaccctttctccacatcctcgttaccattcataatttttgtctatttgataacagctcttttaactgtgatgagatggtgtctcattgtggtttgattctaatttccctgatgattagtgatgttcaacattttttcatatgcctgttgaccatctttatgtcttcttttgagaaatgtctgttcgggtcctttgccaatttttaattggattattattgattttttttgctattgagttgtttgagttccttatatattctgattattaatgccttattgtttggataatttgcaaatattatcaaattctgttggctggctctttactttgttgatttgtttcctttgctctgcagaagctttttggcttgatttaatcccatttgtctatgttgctttgcttttgttgcctatcttacacaaaaaatctttgcccagattaatgtcctgaagaatttccccagtgttttcttctagtagtttcatatgttcatgtcttacatttaagtctacaatccacgttaagttgattttgtatatggtgagagataggggtcaagtttcattcttctgcatatgtatatctcattttcccagcaccatttattaaggagcctgtcctttttccaatgcatgttcttggcacctgtctagtggacaaacttttaatttttctgtgagtaaaagcatttggacagatgttattgggagtggtaatatcattctttgttttacaaaacaactctgttaatagtggaaatgttaggtcaaaagggtgaaaaatgtttttcagagatatcaataaaagtctattgcaatgcaaaataatgtattgggtatggaatagttacaaaaatctttgtgatcttgattaagaagtgatcattctacaaatagtgacatgttgaacatataccatgttcttacctctgtgtttgtcatctcatataaactaagtgcaatagataaaatttggtttaatttgtctctacaaatttaattgtaagagtttaggatttgggatatcattaactcttttaaatctagagacaagcacattgcaaaaagattttttttttaattatcaggtattaaagacaactgagaagtgttatactgaaatacttaaatgacataatttaaagattaaaatattgaggtaagtgttagggtataggtctcacttagaaagtacctgatttttgttcattggattcttaagcacactcattagaactcaaatattagacataatcaatcaaccacttttaaacattatttattgaggcccatttagaatcttggcaaggtatgatgctggatgttacagagaatagggtgggtattgaaaaacaacaataatgaaaaataggacaggaacaaacacttgggagtttaaaaaatatggaaagctattggtctaatttgaaattttctttttctggttctttaagatcattcagtttatgtgtacaactgtattttgaggtagaaattgggatatatatatgaggcattttaaactgaaccatctttaattaataatttattctaccccaataataattaatattctagcctaccaatagtaaattcaaaattgtggtctaacagtatgtaagatactgcaatttcacaaagtataagatacaatatttctcaaaaagaagcatatagtctcatatcggtaagtaatcacctgactatgtgacgttaaatcagtgtcatttattgataattacacaccaaaggaatgcagcattttagagtcgtaagagacttccaaaatcctctaatctggcctcttacatgatttcatggaaaagatgtttgaattaattcaaaataatggataatagggtgaagacattccctaataccagcaaggagatttctactgaattaactctcttctagtggatagctcaaggggcaaccttttttatacatacaaatcaccctttgattgtaacctcttacgtaagttttcagcattagagaagaaatatatttgcctatttctaactttatagagaggattgaaattgacccagtgctccatctcatctcatgccattcaaatcactacacagattccgaaaaggagtctatgaggatgaagtggagtgaaaatgattaaaagaggaacttgctagaagtggtttaagttaagtgtgttactcaatgatcttcaggttgataagctcaactttagtattatctaagttatttatgacagtttcacagataaacgtatatgtggtgctttgaaaattgaaaaacgatgctggataggaaaacaggtggcaactgaaatattcataatccaatgtccctttaccttaatcatggactaaacaacagtttacagtacagtgtgtgattatattaagaatatgactaaacatttatgttcatctagtagaaaataggtgtgaattttgaaagtgataaatgactaccttggtggtattgtaagagctgtcaccaaaaatgagcaaaaatgatacaacgttttgttgtgtctaaatttttattcaaacaatataatttcttttgtaacatatgtctcattttattaaattcattttatgtgccacatattgccaaacagctcacattcaagtacttcaggagaaaaagttgtatctgctttgtatattgaaaataatcataagtttcttcatatgactagggattcaagctgaaaaaaatgagagatgggcctgttaacgtggatgaaatctcaaattaaacaaaaaccatgattaaaaaatggtgagagtaagcacgtgaaaagatgttaaacatcactaaccattaggaaaatgcaaatcaaaaccacaatgagacaccacttcacattcattagaatggctgtcatgaaaaaaatattgcaacaacaacaaaaataacaagtgttaacaaggatgtggagaaattaattggaatctttgtgcattgctgctgcggaagaaatggtgcttcctcaaaaaagtttgcatagaataactacatgataaagaaatgccactgctatgtatgctaggtatatactcaaaagaatggaaaacaaagacttgtacatatacttgcgtgccaattattataccaacattactctcagtagccccccactccccgaaaagtagaaacaactcagatgtttattgatggatgaatagaaaaacaaaatgtggtatatacatgcaataaaatattatttagccttaaagaggaaggaaattctgacacatgctatcccatagatgaatcctaaaatcattatgctaagtgaaataaagcagacacaaatggacaaacagtatgattccactaacactatgtacctaacacagtcaattcatggaagcacaatgtagaatagtggctaagatggtcatggaagcacaatgtggaatagtggctaagatggtcatggaagcacaatgtggaatagtggctaagatggtcatggaagcacagtgtggaatagtggctaagatggtcatggaagcacagtgtggaatagtggctatgatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagcggctaagatggtcatggaagcacagtgtggaatagtggctaagatggtcatggaagcacagtgtggaatagtggctaagatggtcatgggagcacagtgtggaatagtggctaagatggtcatgggagcacagtgtggaatagtggctaagatggtcatgggagcacagtgtggaatagtggctaagatggtcatgggagcacagtgtggaatagtggctaagatggtctggggagacggaataatgtgaagttattatttaatgagtacgaaatttcagtctggaatgatgaaacgtgtcaggacataacagtgatgatgtttgcactgcagtgtgaaaacccttaacaccactgaactgtacacttaaaaatggttaaaatgatcattttatgttacatatattttatcacaacaaaaatagaatattttaatcttgacaaacgtaaccacagaaaacaacttacaaaatagaatttcagaaatttttgctaaattggaatacatgctgttttatttctacgagaagatggatagtaggttatttggagctgaagaattataatgcagcttccccaaattgtgatctcctatgtggcagtggttagaaacaaataaaattcttatctcttatccttaaagaaaatcgaaattaccacacatgtatttattcagatagctgttctgagttagacggcaaaatagagcttttattaaaaagtaggatatattaaatttaaacatatataatgtgtagatcaaacattcaaaaagcagaactaattaaaaactggataaacattttagaccatattaaaaattttaggccgcctttctaaagtctagattacattggattaccattgtagaattgaagagtggttggttttgaattttacagttgtaattgcaaacttgcaaaaatatatattttaggtgctactatttcttaattttcattttgtaaattaactagctcttttgaacagcatttttttttcttagtatgatgcctatgagaaaaactacctgccttggaggaatttgtaatagagaaagataatatgtgtgtgtgcgtgtgtgtgtgtgtgagtgcatatgtaaatatttccatatattatatgaaaagtgaagttgaataacaagagaagtttttctttgctaaggaaaaaatacatttgtttttcattaagtaaagattattatactggcattattttgttcttacattggttttcagaaagttcaatggcatattccgctgtatgagccatgcagagctgcatttatctactgtattatcttcctcccttttttctagatattccttttttgtctgtgtttttcttcctgctggtttagtgttatgcatatcttattattttactatgcaatttcttatcttgttgtacccaagcgagttagtgagaacgccacactatgagatgaatcaagagtcctttattaagccggcggccaaagagacggctaacgctcaaaattctctcggccccgaggaaggggcttgattaacttttatacctaggtttaggaaggggagggggactcaaatgcaataattctacagaagtaaaaacatgcaagaatcaaaagaagcaaaatggttacagagagataaacaatttaaaagacaaatggttacaaaaagagcaacggtaccaggtgcaaggctctaaatctttcattataattagatacagggagtatgccggacaggaactcaaggctttatgttttctctctttaagaaaaatcctgggaacttcatacattgttggtgctagtaccttatcagttcattgggctcctttgaaatgctgaggatctgcttacacaggtcaactcctggcagaagcgggttgggtaaggagcccttagtgtcttgtaaattatggggtcaattggagtttttccggctttcccagctagagagagtcttatttacatgagaagcaaggctaggtgattaaagagacaagcaggataaaattcaaagtagcgagttagagtaaaaacaaggttaggcatttcaatcttaacgtcagaagattttgaggttaaataataaaaccaaatctaataaaagtaaattataaaattggtcacaggaaaaaaagggggaaatagataaatataatgtaaagagccaaaggtgagttgaatatagtgctgtactgaatcccgagttgggattaacctagacttgcagctggagttcttcagcaagctgtgatgtctctgacctagatttagctatttgatatgagatcttgtaataggtgaattttgttatgtgaagttgtgggggatgaagttggaaaggactttttatgtgacctagaatcatctgtttgtcatttgaagtcagatgaactattctctcttctgggaatctttcctacttctgcctattcatatttagggtaaatgattattgtgtttatctgagatgccctatggttatgtttgaatattacttacctgtctcaacaatgtttaatacggtagccactagtctatgttagactattgagcacttgaaatgtaattatttggggctctgagtttctcaaatcacatggttggaataaatttagactgcatacatgtggagggacagacctagttatttgattcatctttcccatgatgaatttaaacttttaaatttttttgtcagacctatgtcaagacaagtttcttttttctttctttctttttttttttttttttttgacagagtctcgctgtttccccaggctggagtgcagtggcacgatctcagctcacttcaacctccacttcctgggttcaagtgattctcctgcctcagcctcctgagtagctgggcctacgggcgcaccaccatgcccagctaatttttgtatttttagtagagacgggatttcaccatgttaaccaggatggtgtcgatctcttgacttcatgatctgcccgcctcggcctcccaaagttctgggattacagacatgagccactgcatccagctgacaagttttttttttaaatttgttgcattggttaagtttttttgtcttcactgtgcttgtactctgttaaggtcctagatttaatgcacaagcctcagttttaaccaattagttttggtaggcccaaagctcactggctctgtaagaggatcagaatctaattccttgatcagatatccaggtccagtgctcctctgctcctaccccttgtcaccacggctcttgcaatatattatctgtgtgtgtgtgtttgtgtgtgtgtgtgtgtgtgtgtgcgtgtgtcgtttcattagaaatctctaggtgttattttaggattgtttctgagttagcgtaattcctgatttgggggatcaagaagattttattaacagtattcagtgtccagtggaatgttgcttaggatttgtaagagaggaagaagatcaaaatagtgctttctgaagatttttctggttgtttgcctgtgagcatattacaaaggaaagacagtcgaacaagatgccatttatttaatggctttgatgatgaatgagaggaaacttgttttaaactgaacacaaatctaaagacaaatttactaaatataatttgtccttttcagatctatgtacagttactctcccttacaacgatattaaaaactctcacagacattttttttctcccaagaggattacattattgagaaatgtaaggggccttaacacttgccggaataattaatattttgtccgtcatctatctaagatgagttgtctcgaacagttctgtatctcatgtggctttagtttgatcttagaatactggcttagaaacctagggatagcatggtctggataaaaaggaaggtctgtaacaatgattgaggctattggtctatattgcaaaacattttgcacatttgtactttttaaagtttctcttttttattttacattgatgctaataaaaaggcttttaaaaaatttaccattatgttctaataaaagtccttgctttgatttggaaaggctaagttatgagacagccacataattttcattaatatcaatcatgtgtacaaatattttagcatgaattcttaaaagcttaccacgatttgagcacagttttgttgactgatgctttcaactttcaaggcagaagatattcaaaagtagcaaataccctctccagacttttttctctgaatgtgaaaagcctataattagcaagtattttgtcacttggtaagggaaatgcttcagagataaacaactcatggactgtgaaacactgtagcagaattccaaacatttagatttggaagttttttattcattcgatatttgagtgcctgttaacgtgaatatgcagtgctgaattggacagattttactctaatggaattaagaatctggaagagaagacagacattacatttatgattatagataggatatactgtaggtaaggagaagtgttgaattttctgaatgtttatatcaaagtaatttaggtcaagattatgattcacaaaatgtggttctcagacaagtagcattaacatcatcaggaagcttcttagaagtgcaaattctaggctccacccaagacatactgagtcagaaatactggggatggaactcagcaatctgtgatttaatgttttctaggtggtgctcattgctcaagattgagaatagctgttctaggtcagagtttctcaacttgagcactattgatatttgggccagaaaattctttgttacaggagtctgtttcgtgcattgcagtttgtttagcagcattcctggcctctaaccattagatgccagtagcatcccccagtagtgacagccaaagatgacaccagaaattgccaaatatctccagaaggcaaattcttattagcagttccctgcttcccctcccccacattgccccaggcaatactcaaatgacttgccctgccttttatcttatcctatagtgtgtggtaaggtgctctgaaacaggacaaaggaattccaccatgtttattcattatgaaagaagtaaatttgagcccaagaccagagatggtccaagttctggtcattttagtctttcattttttgccttgttttcaacctatttttcttctcacttcaataaatactcttatatattaatcctgttttatccttaaatagtaacacattctgtttatgttctaaacttagtgatttgatgaatctcatgtaattaacatgacggttagactcaggcacctgcactttccaaagatctttgaacataattaagaaagtgaagggcataattttaatagtaaatcaaaatattctcattgatgaattatgttataataagtctctgtcaatcacagattctcttgggaatttgtttctttccaagaagtgctgagtctttctctgtagttactcatctattatatttcaaaagtgtttctgaatccatggttatgaagtaggaatatccagtttcttatctgtctgttaaccaagttccaaagtgttttagttttctgggttttagactataggtggtcctgtttgagattgctaagacccaagtagataagagtagttgcatttaaaaagcagagattactgcaagtatagaagtaatgcattttggtaggtttgcaaacatatgtacactttctaaaatgtctagatagctgtgtacctatggaattttttcacaggttagttttgctggtaggcctataacaagattcaattatcattaatatttggctcacattagctaactcataagggtcagtgatatggtttggctctatgtccccacccaaatttcatctcaaagtgtaatccccgtgtgtcaagggaggcacctagtgggaggtgattggatcatgagggaaattcccccatgctgttcttatgatagtgagttcttatgagatctgatggttttataagtgtggttaccctgctctctctctctttcctgtcaccttttgaagaaggtacttgcttctcctttgccttctgccataattgtaagtttcctgaggcctcctcagccatgcagaactgtgagtcaattaaatctctttcctttatgaattacacagtcttgggtatgtctttataggagtgtgaaaacagactaatataagaaatttgtaccagaagtggggtactgctataaagataacatgaaaatgtggaagcaactttggaactgggtgacaggcagaggttggaacagttgggagggctcagaagaagacaggaagatatggaaaaatttggaactttctagagacttgttgaacagttttgaccaaaatggtgatagtgatgtggacaatgaagtccaggctgaggtgatcttagatgaacagtttcctcagagatgaggaacctattgagaactggggcagaggtcactcttgctatgctttagcaaagatactggtggagttttgtccctgccctagagatctgtagaactttgaacttgaaagagatgattttgggtatctggtggaagaaatttctaagcggcaaagcattcaagaggtgacagagcataaaagtttagaaaatttgcagcctgaccatgtggtagaaaagaaaaacccattttatggggagaaattcaagctagctgcagaaatttgcataagtaatgaggagctgaatgttaatagcgaagacaatgaggaaaatgtcttcagagcctgtcagacctccatggaagctcctttcatcacaggcctggaggtctaggagggaaaaatggttttgtaagatgggcccaggaccccactgctctgtgcaccactgggacttggtgtcctgcggcccagctgcgggtctaggaggtctaggagggaaaaatggttttgtaagatgggcccaggatctcactgctctgtgcaccactgggacttggtgtcctgtagcccagctgctccagctccagccatggatgataagggccaaggtacaactcaggctgttgcttcagagggtgcaagcgccaagccttggtggcttccatgtgaagttgaggctgccagtgtgcagaagacaagaattgaggtttggcaacatttgcctagattttagagcatgtatgaaaatacctggatgtctaggtagaagtttgctgcaggggcagaaccctcatggaaaacctctgctagggaaatgtggaagggaaatgtggatttggagcccacacacagagtccccactggggcacttcccagtagagctgtgagaagagggccactgtcctccagaccccagaatggcagatccatgtgtaagaattaaagaaagaagaaagaaacatgaaaagcagctcaacagtcaaagacacttttattttttaatataaacctgagagggacttctgaccgatttcagtcaggagcactctctcttacagactaagagtatttaaggattcagggtgggaaagcttatcacaggctcggaatgtttctgtgtctctttgtcttgcttctctgggagagagactttttgtgtctatttccatatatcttcctgaagctgcaggcatacccgtctgagttgcttttacctttcctatcttagtgcacctaaagggaaagggatgtgcttattaggtccactattttactggggcccattgtattagtgtgaagtttggcgattaccaacacaccttcccccttccttctgtgcctgagctgccttatctgtgttttactgtctgctcattctggctgcttgttgttaaaagagaagtgatttccttgaaatgcacgaggttagaaagggagctggaacttaaaacagtggtatttgaccaggatgacagtgctcttgctctatcaccatgaacagcttgtaatgtgcacctggaaaagctacaggcactcaacaccaacccatgagaacagacgcgggggtggaacactgcaaagccacagtggtggatctgcccaaggccatgtgaatacaccatttgcattagtgtgtcctggatgtgagacatggaatcaaaggagctttaagatttaatgactgcccccactggattttggactaggatgggggcctgtagcccctttactttggccaatttctcccatttgaaatggggacatttaccaaatgcctgtacccccattgtatcttggaagtaactaactggtttttgattttacatgctcataggcggaagggacttgctctgtctcagatgagactttggatttcagacttttgggttactgctggaatgagttaagactttcagggactgttgggaaggcatgattaaaatatgaaaagggcatgagatttgggaggggctaggggtggaatgatatggtttgtccctgtgttcctacccaaatctcatctcaaatataatccccatgtgtcaagggagggacctggtggtaggtgattggatcatgggtacggttcctcccatgctgctcttgtgatagtgagagagttctcataggatctgatggttttataagttgtggtgtcccctgctctcttggtctttcctgctgccttttgaaccaaagggacttgcttctcctcatcttctgccatgattgtaagtttcttgagatctcctcagccatgcagaactctgcgtcaattaaacctctttcctttgtaaattacccagtctcaggcatttctttatggcagtgtgaaaatgggctattatagtcagtgagggtcaagcatgttttatctcaaccaacaacagattcttgggtaggatggcagtaatgcagtttgataccaaaaggtgatggataggatgatgatgataataaataatatgtaataagaacaaattttagaaggatatgtttcaaagagtacagaagtttgttagacctgactggtattggatagacataacattgtttaagttcgacagaaggagaagatccaccctgtgtggggaacaatgagaacaggtctgaggtacagtgaatgagattgttgatttatgggaacggtgaagttttggaaaatacacagaatgagatgtggcatacttgaaagattctattccagggaaaacatacacacactggaaaatggagatctcccttagagactcgggatagagaaagaagcagctaaaaagaattgggttctatcagaataaaataccaccagtcaataagaagataatcaattaaaaacaggctaatgacaaacactaccataagatgataacaaaagtctacctgcattaaataaactgcacaattgtactttaatgtagcgggaggtagaacatgtacccttgaactaaagctaaagccaagtgagccccctcctcccttgagtatcatctgctagtatgggagaaaaataattcaagacataatcctgatcataaggaaaatagaatccaatgtttgtaaaacttgctatataaagaaaagtattgcttactattgctggacaagaaaaattcaagatatgaaattctgatcattaaaaaggatcccaaaatttattaaaatattatgtgtaatgaaaagataataaatatttattgaatgaattcctcaattttcctatgaattgagaagtgctcatgaaaatgcataggtaaattataaaatgctattccatttcattcagggctctgctgagctgaaataccacagagatccctttccagactgaattgtttgaaaaagttctccctatcactttcttcatagcacatatcatttgaggttttactatttttctgtccttcactagagaataagcaccatgtggtcagtgagttcatttgttttaacttgtggtctctcatacctagaatagttctggccaaatagaagacactcaataaatatttgttgaatgaataaatgaataaaaaaacttcattaaatattttgaagggattttcatataaaagaaaaagaaatgctgaacttttcagcaaagtaacccatgtatttgagataaaattaactcctccactttaagtttgatttacgcaaaaaaattgtacatttttaaactataattgtaacctgataaatatattttctaaataagttaataaattttggaaaacatttgatgcaagatatactgtgagagagccatgagatctggccagttgaccatgttactattggaaatgttaataaaacagtaagattgctgatgttgctttccattagaaaaaaatatcagagaaacatatgctaaggggataaacaaaaatgaggagtctagagtctacttgatcttagttattgagacaattctattaacaagagagtggggggccaatataatgtggtctattaacaagagagttaaggatcaatataatgtggtccttaactatatccttacataatttgacacatgaatgtgcaacatagtaaagcattagtgactttatcatgatgagcatcagatttaggatcctgtaatgaacacatcccagtctctcttctagctaaatattgaagtcagaatggagagattgcatcctttggaggcttgacggagactttgattgccatttggccttaagctccatatcaagctaacatgaattagaaaattattcccacactgctgtaaaggtgaagccatagactccatgtcagatcctcggcacatatgtaattgagtttgtgccataaatagcaaggtagtacagaagttacgtgaaaattagtctgtactatagttacaaatatgtatagtaaaaattgtgattaaattcagggcattttaaacttgagttgtccttttattattcggagacaaatatagtaaaatctagaggagtggttttaccccaaaagcccaagaattattcatcagcagaacaaaggcataaattgaggcctcttgaatcccaatccttttgtactctttaatacaggtactcttggatttatggtgagtttatgtcccaattagcccatcataagttgagaatatcataagtcaaaaatgcgttaaatactcccaacctaccaaacattatagcttagtctagcctgtcttcagtgtgctcagagtacttacattagactgtagttgggcaaaatcacctaacacaaagcctattttataataaggtgttgaatatctcatgactgcatgtcactgcctggaaaaagataaaaattcaaaattcacagtacattgaaattgtgatggttttatatcatcgcacagtggaaaaattactaacttgaaccagcataagttgaagaccatctgtatatgacacttacctgcagagaatcatctggattctaactgaataaagccctcaactgagatttttttattgcgaaactttgatttgaaacacagtgaataaacatcaaaatataaggtacaaagatacaagtcaatactttgaatataagaaaagcaacctttgacaataagattccaagaccaggatagtcaacattactctttcatcgtgactttaggatgaccaaggcaggcacaatgaagataaaatatggcatatccttgttcttcttcagagccatgagtatttgctttttgtttaaaggtgtttttagcagcttgaagaagctgctaaaccattttttgactctgaatgttcaggaaactatgttgagctctgaagatgcaataatttttaagttatctacatatatctctctctttcttaccaaccatacatctgtgcaccatgttagattttatttgttatgattctcaaaataggagataatgaaaatattaacagactgctgtttagtttataaaatgctgtttttcagttaatattaaattctgaacaatatgactagtattcttatggttgtcttactcatgaggaatctgaggctcatagattgtaatttgacacaaattacaaaccttctaaatggaaaagcacaagatagggatttctgactccaaagccagtgtttgtttgtttgttttcttactgtgttgcttgtagcatctacttacaggcattattattattgcttaaaaaatcttgccatctgtttacattgacttaccactttagaaaccatttgctaaaaagttgacagtataataaaagtattccattattaaggatgaataattagaactagatgtgaaaggtgaaagggtagagtttaaatacatataatttattatttaagaaacttctaataaagaagattcttttacaatatgactgactataccttccaaaatttcagtgaatgttattaaatcagcatcctcaaagatttcatgtctgccaagtgttgcagacaaaaataaaactctttgaaagcatcttgccaattgtctctagctcctttatgtgatgaaatgtttgtagatttattataaaatcataatttccattttagtattttcataatactatatttgatagaagtcacttaattaaaagtgttgtcaagggaagtcagctgaaaattaagaaagcacagacagctgcctctgttgctaccatgaaatttatgtcttttaagaagtactttattctcattcaacaatgtttgcatgttggttaatttcaaatgtatctttcaaatttatgaatgtataatttttattaaacaaaaacattataaaaattaacgcataaaagtgaaatactcatgtttttatacagttaaatttagaataaatgtaagttttttgaaggaacaaagtatcgtttgtataggagagaaagaatgtgtgtatgtgtttgtgtgtgtgtgtgtgtctgtgtctgtgtatctgtgtttatagaggtggtgaaaatttattaaatccccccaaaatggaactggatatgacattatagtgtatttggtctacctagaccaccttacttgtcaacagatgggagccaggagactttaaataagtatcttaaggtcacatagtatgttagtagcagagcagaactagaacagattttctcattctcagttatcttttctcattactcttcttcttctttagttttatttgttatttgtgataatttacagtgcatttgtgaattgacatgcctatgagacttctgttggcctactttgcttaatcctaagagggctattacatgaggacatctgaattgagaaaggcaggaaaatgtatttaggtgtgacattaatttgtgacctatgaaagtgctgtagcatgcccccatatctaggccttcagtttaaacaaattggttaaataggggctgtggctcccacactctctaattcctaaggcttttctctcccatcccaatgtaagtcaatgctgattgaacctcgttcacttaggagtgtccttgtgactgccttctgggtataaatgctcaagataatgatgacacgtatggtaactgtattctcctgtattctgagagatgaaagtgaactgtgattctgcttgcaaggtatctgtgcctgcttgtattcttccccagcatttcccagtctttctgacttttccatagatcttcatcatttccatagacatttgtcttccttctttttttaacttttacatgtcatatgggagtggcccctgtaagtatcatttgttcttacccaactttctctatgacataagaaaccttttaaatactgatcaaaataattcaggcaatgttctttaataatataaaatataagtattgtgtttcagatgaatcagacatattcgtttagtaggtcagattctccatatcattatagtgatgagcatatagtaggatttatggaaatacttcacttacatttcccttatggagatgacaatagtaagaatttttactttttttcttacctttcactacgtaaggatgagcttggattatttattttaaaatccataattaggcatttccaactacttaatatggtttatataaacttactaggaatatctgttgaattaaaaccttaccttatgtttgattttaaatgtacctgtcttaatccttaaaataagaagggtacatttttttcaattactcctcacttaagaaaagatattcttgagtagttatttataataaggagatcatggactacttacattttaactcaaattcttcttaagtgtttacatttttaaatattgattattgctagaaggaactcatacattaaattggcatactctttttttattcttttcttgccttattttcaattattctataaattagaaaattttttttcttagaataaacaaaatcacagtgttctgagattttgcaaagtctatgtcactgaataacagtgaatatgatttttccttatgaatgagaatattttctctggcaaaaatagaattaaattagaaatcaactacacaaataaatttgggaaaccctgaagtatttggaaatttatgaatatatttctaaaagaggtcacaagaaattgtaaaatattttggactgaatgaagactaaaatccaacatttcaacatttatagaatgcaactaaaacggtagttttgggggaatttatagttttaaatgtctattttagggaagaataatattctcaaattaatatccctagcttaatcttaagaaacttaacaacagaaaagcaaagttattcaaagcaaacagaaggaagaaaataataaagattaagatggaaatatacccaaaagttaattctttaaaaagaccaacaaaactgacaaaatcttacctagatttactacaaacatgagggaaaacacaaattaccaagactgacaatgaaagagatgacatcattaggaccctaaagacattttaatatattataaaaatgttattataataatttagataactagcaaaaatggataaagtcatggaaggacccaaattaccaaagtggggtcaatgagaatttgagagtatgaataaaactataaaattgaattagcaatttaatatcttctctaaaataaaagccctctatctcatggccttattcaaaattctgtgaaatatttaaagaagaaatagtagtaatctttcctactggtaccagtaggaaccataaaaatgtattttattaataggctagtgtaatcctaattctcatatcagacaaatgcatcacaaggaaacacaaccaaacagataaataaacaacaaaaactacagactaatatttttcataaatgtagaggcggaagtctttaacaaaatattaacaaactaaattcaagaacatataaaaagcattatacactgtgaccatgtaggatatattccagacagtcaaggttggtttgtcatctaaaagtcaaataaggtaatacattatattaacagaataaagtaaaaagcaacacagtgaactcaatatacagaaaaaaattgaaaaattctaatagtcatgataaaaactctcaaaaaactagtaataaaagggaatatctttaaaatgacaaacagtatttagttcacagcggatataatacttaatggtagagaatgttaatttaatatttctattaaaatctgaaatgaggcaagaatgtctgttctcatcacttctattcaacatagtactgaaagatctagccagtgcattaaaaaggaaaaaaaagcaattaacagcactcaaattgaaagagaaatgtacaattattttacttctcagatgacatgatcctttatgcagaaaatacaaagagatccataataaactacttgaactaataaacaaatttaccaatgtcataggatacaagattaatataattgtatttctgtgtactttcaaggagcaatctaaaaatgaaattatagaaaaattatatccatgacatcagaaataagatacacaaaaaaattaagaatataatgtaaatgtaagtataatatatattaatatagcataattataatgaatatgaaataaatataaatatgtaaaataacatcacaaactaagaatataaataaaaaagattaaaaaatctgtgttaaaaactacaaaatgttgctaaaacaaattgaagatctatataaatggagagacattccatgttcatgaattgtaagtctccatactgtgaagatggcaattctcccaaaattgatctatacattgaatgcaatttctatcaaaattctaagtaggctttttttggaggtagaaattgatgagctggtttagaaatttatgtgaaaatgttaaggacctaaaacagccatgacaatatttaaaaataagaaaatggccatactgcccaaattgatttatagattcaatcctaccccaatcaaactactgttgactttcttcacagaattggaaaaaactattttaaatttcatatggaaccaaaaaagagctcacatagccaagacaatcctaagcaaaaagaacaaagctggaggcatcatgctacctgactttaaactacaccgcaaggctacagtaaccaaaacagcatggtactggtaccaaaacagatatatagaccaatggaacaaaacagaggcctcagagacaacaccacacatctacaaccatctgatctttgacaaacctgacaaaaacaagcaatggggaaagaattccctatttaataaatggtgttgggaaaactgtctagccatatgtagaaagctgaaagtggatcacttcctttcaccttatacaaaaattaactcaagatggattaaagacttaaacataagactaaaaaccataaaaaccctagaagaaaacctaggcaataccattcaggacataggcatgggcaaagacttcatgactaaaacactaaaagcaatggcaacaaaagccacaattgacaaatgggatctaactaaactaaagagtttctgcacagcaaaagaaactaccatcagagtgaacaggcagcctacagaatgggagaaaatttttgcaatctatccatctgacaaagggctaatatccaaaatctacaaagaacttaaatttacaagaaaaaaacaaccccatcaaaaagtgggtgaagaaaatgaacagactcttctcaaaagaagatcattatgtacccatcaaacatatgaaaaaaagctcatcatcacttttcattagagaaatgcaaatcaaaaccacaattatatatcatctcacgccagttagaatggcaatcaataaaaagtcaggaaacaacagatgctggagaggatgtggagaaataggaatgcttttacgctgttggtgggactgtaaattagttaaaccattgtggaagacagtgtggtgattcctcaaggatctagaactagaaataccatttgacccagcaatcccattattgggtatatacccaaataattataaatcattttactataaagatacatgcacacatatgtttattgtggcactattcacaatagcaaagtcttggaaccagcccaaatgcccatcaatgatagactggataaagaaaatctggcccatatacaccatggaatactatgcagccataaaaaacgatgagttcctgtcctttggagggacatggatgaagctggaaaccatcattctcagcaaactaacacaagaacagaaaaccaaacaccacatgctctcactcataagtgggagctaaacaatgagaacacatggtgaacagtaaggggaacatcatacaccgggacctgtcagtgggtgaggagctaggggagggatagcattaggagtataggagtaatacctaatgtaaatgatgggttgatgggtgcagcaaaccaccatggcacatctatacctgtgtaacaaacctgcacattctgcacacgtaccccagaacttaaagtataataataaaaacaaaaaagaaattggaggaattgccatacccgatttcaaaacttactataatgttacagtagccaagaaaatgtggtactatcataatgacaaaaatataaatcagtgaaatagaattgaaagtcaagaaataagcccttaggtttatggccaattaatttaaaaaaatagcaaggcaattcaatgaaggaaagaatagtattttcaacaaatggtgataggaaaattatatatccacttgaaaaaaaatgaatttagaccctgataccacaatagaaaaaaaattcagaatatagaagaccttaatgttagcactaacactataaaactttttagaaaaagactaccagataatcttttaccttgatttagacaaatattcttaaatgtgatatcaagagcatcattcataaaagtgaaaattaataaacttgacttattgctaagagaatgaaaagtcagggagaatgaatttgcaaaccttatattttatgaagatcttatatctaaaatgtattttaaaaaatcaaaacaaatcaggcgagagattttaacaaattttttaccaaagaattcatgtgattgggtaatacatacatggaaaggtgctcaccatcattatctttcaggaagtgcaaattaaaaacataatgaaatacctctatatatctacaagaatacctataatcaaaacggcaacattggcaaaatgcggagagactagaacctttatgcattgctggtggaaatacaacacttggggagacaacgtgacagtttcctaaaaagtaaaatgtgtacttattacataacccagtaattccactgttatttatatgccaatgcaaaacgagacatacagctatgcaaaatcttgtacaggaatgtttatgacaacattctttatatacttaaacactgcaaacaatacagaattctattaactagtaagtggataaaaatgtatatatatacagtggaatatgaatgattaacagtaaaaagaacaaactcctgtggctactataagatggataagtcctgaaaacattatgctgattaaaagaagcatatgtactgcgtattgtatgattccattcaaatgaaaagtccagaaaagccaaattttctagagacaaagagcagattgcctggtgattgaattttacctatacaatggctaaatttttaagatatgaacattacacccccaaaatgagagacatggaaggagtaatcagagccatttccagatgtaatctcagcctcttaccatagggatgatatggactggaggaaattctcaagaatgtgattattttaattatgatgggaacaaggtaactataaagaatagaaaacaaacattttagagataagccctgattccatttctgtattgaatttacagataattgtttagacactacttttgatcgaaataacatatataagctatttagacttaaaagaaaaagacatgtagaaagtttcctctagttgaacaaaaccttcaactgctttctgtattcctattttgactctcgaaaagaaagaaaatgaaaaggcaaacaatgggtgaagagcttttattcaactacattcttttacctgatatgttttaggttcaataaaagccaattttatgagtttgtggatatatatacacacacacatatatacgtattgagcattgcttgaatattgagacttttggaatgatcaggtatagtaaaataaactctgatatagaggactagaaagaaaaatgactttttaaaaataaaacaggtgcatttgtactttgaatgtacagtgtatgtgtcacatgtttatatgtgatacttatgcacattacttatatacgtatttaatgttaaacatgtaaaatatacacactaagagtacatgttttgtttatattttgctaggttctcatttaatcacaaggaatattaacctaattaaggcacaacattttctttttgccatattctaacagcaaagataaagagacactccagtgtcatgttatatgtatgacagatgcttacagtcaacaattgccactgcaaacagcattggttagcaactgtattaaacttagacgtactgttggtgatttgggtggacttaacagttgtcaaaatttggggtaagtcagttttcatcttgtgagtttgatttttttttttttttagtctgggtcatgctctgttgcccaggctggagtgcagtggcacaatgtggtctcactgcaaccaccacctcccttgttcaagtgattcgtctgcctcagcctcccaagtagctggaattacaggcacgtgccaccacgcccggctaatttttgtatttttaatagagctgtagtttcaccacattggccagggtggtctcgaactcttgacctcaggtgatccacccacctcagcctcccaaagtgctgggattacaggcatgagctaccacgcccggctgtgagtttgattttaatataaagttttctaaccacatgaaagagtttctattgttttgattaccatggctataattgatctcaatttttttcatgcaggcaatattagcattgtgatacataaaatatatactcaatttaattctttgggagtgaccaccagctctctccttaactgactactctctagggataaaaaagcaatttgaggaaatttgggccatgtaaagatattgtaaacatcaaaattgtgagaaacaaaaactaaatataatatgaattcaaattgtgtgtgtatattcacataaaatctgtccaacttccaacagttgaatgactggaattatttctaacttctgagatttgatattggttctatgactaaagaacaagctggaaaggactaccatgttattagaccacccataggtaaaattattttcaaggcttacatagtaaaacatatattttatatatatatatacacacacacacctttgtttgcattattatactagatattgtggctataaaacagaatagaatatgaaatttgtcctcaaggatgtaaaagtacatttatctttttctttcttctcagaacattgtaataaatgtagtacattttcctctgtagaattagtaaccatagtattcatttgaatattcagtggtaatgtgagtttcaatttttagctttataggtactttctagtgactgatataataggtttcagaggcccattaactctacctggtgtccacataagtaatcacatactctgttgtatgaatggcttacatttttcataacgacctgcaaatataaaacctttctttctctccctattagttattctctcttggcacgtaagtagaagagacataatgaaataccaggagttttatctatttgaactcaagtaatatctcccaaggtgacattcccatgggtaaaaaagcagtcttcttcatttttgtgttttaaaacacttatttagatctagacttaagtgttgcttttcttgtaggagtttgaaaatgcttaacagtctaaagttaattattactctttacaaatatattcaagtttctcaagttatctaactggctattcttcctggctggttgcctgtagattttcttagaaaatttgctactttgacagggtagagttacatgatattgtccctactgttgtattctggatgtctctcatgctgccctatcagaatcccgagaaatggcataggaagatcactggagggtacactgagcataaattgatctggctactgccaggtcttgagaatgagaagagggaagagttgctgtgtatgttgagcaattaaagtactatcaaatgaatctgatcacaacatattgcctggaaatatgctatattgctatggcaaagtctattttgtatatgagattgattgttccacatgagggcaggaacttgtctttcataatgagtcagagaagtgacaatttctcgttatatttcagagttatgggggattgactatagtgtgtattctgcagatatgcctcaaagataaaaataaattaaatgcaatggaaacgtgttgatgaatttaaaaagttgttatttaacctattggtatttattagctcccctgtggcttctatgttgagaataaaaagatgaataaaacaagtttacactaatatcttgtcatctcaaacgctcaaaatagtcagtcttaaatgactgatttgatgcttttttttttagtaaaatttaaaacctagtgactaaaagggcattctttggagtggcagagatgttctatgttttgattgtgatggtggttatatgcttgtatatatttgtctattaaattttccattaaatactgttaacatgggtagattttgttatatgaaaatttgactcaaagtaagttgatgttggtcaaaaggtgcagtttcagttacacaggatgaataagttctgaagatctttcatacaacatggtgactatagttaaccgatatcatattttatacttaaagactgctaaaaagaatagattttaaatgttctcaccacacttataagcaaaaactggtaactctgtgaagtaatggatgtcttaaccagtttgattgtagtaatcatttcacaatatacaggcacatcaaaacatattgtacaccataaatatatacattttttccaactatacctcaataaggattagaaaataaataaaaatggtttattttctctctcattatataatagatgataatgtgtaccagtactgctggtaaaagtattataaataatatttgctaatatatattaatgcagttacagattattttccctttgttccgatgttctgattgtggaataattactgagtatagagttaattccaggcttgctctttctctctgtttctttcttctctttcactcacataaactaaaggcataatttaataaatgccctttcgtgtggacctttggaatgtcttttattccattaaaacttagagaaattgaatggtattttaggcctttaacacattgtttaatttactattttcttctaaagaattgggatttcaacaatccaaaggtgcctcaagcttaacatgttcaaaattgaactccctgttgttcctcactaacttgtatcttctgctctccaaacttctgtgaatgataccgtcacttaccagtcacacaagacagaggtctagaattcctctatgcctcccttttcctggtcctttccctatgaactgtattccagtcccatcagtccacctccttgacacttcctggatccattcccctggagttactgttgtgcttccatcttaattcaggctccatttatcttttacctggcctactgcttttctacaattaatacttctgcagcagcaaggtgatcactacagtgtcaaattggttatgtgaactcctaaagtttaatcttttactaatttcccatttcctaaaaggttagaatccaaattccttggtatgacacacctccatggtatgacatggaggacaaggtcctccatgatatgaagcctatccacctcttcaatagcaattatagaacccgaccatatttaataagtttatttaatattgaatacagaatccgaaaccgtaataggttgtctcacacatatataaaataaaagtattataaagaatatttgctaatgtatatttatgcagttagtgattattttccctttgctctgatgttttttgtttttgttcctgcttttgtttgagagagtttcactctgtcacccagtctggagtgcagtggcacgatctcagctcactgcaacctctgcctcccaggctcaagcaaccctcccacctcagcctccccagtagctgtgactagaagcacatgccaccatgcccggctaattgttttgtatttttagtagagttggggttttgttatgttgcccaggctgctcaaacttctgagctcaggcaatctgcttgtctcagcctccgaaagtgctgggattaaaggtgttagctgctgcgcccagcctataatttttaattaatttattttctctatctggaataaccttacacaaaaagggtcatctagtgaaatagctactctgtgccagtgtcaactgcatttggaaattactcatattcctctgagggataaatgaccaactcttccttataccactacagcatcctatttctatacatgcattactttgtaagttctttgcagagcatttccataactgattcagctctgagattcctataccacacctggcatctgacacatggtaaacaccaaatccttgacaagttactgactactatttatattttatgtgatttatttaagctgaactaattatgatgctttcaaaatttaaatgtgtatagttttaacatcaatgaaatccagaagagatagttgaaggaaaggtttctgaggtttttaggatggaaggaagcataggtaaaagatcataaaactgtcagcagctttttaaatatatagagtgttacataaacacatatctgtccataagtagtgatgccataaaattgtctatccttcacctcaaatacacaaagtgtaatttattttttctttaatggatttggtcttccttatgtgatgagtattgggatatcatactttattttggtccatttgcgtctaatctcacattagtctataatgctgtagattcaagtatccctttaggcagtgctgactttcttggttaaaaatcctgtctctcaaccagtacctctctacctccttaccctaaagtggcatctgagggaagggttgacttcctaacctcttagtgctgagataagatccctgcattgtgatgccctgcgacaaatgtgaattccttttctttttttctcctatattcctgcagttgctggtctctctgttggtcataatggctgagctcctaaactgtttgagtccagagtggcatatttcttgtgtgtccagtagagactggtggtcctctcttgcctacccaagctcttcgtggctcatgatggtgacataggctctctgaatcacggcttcaattgttatagggtcctcactgttcaacctccaggccactttgccggtccaactctactctagattaccctgaaatgattcaaatgataccatgtgtctgtttccattagtgaagggtgatgtgatagagcagtcccagtcataatgtctttggagctagaacaagaatataaatggagattattagttttacattaaatatttaactcatgaatcaatctgacagtttgttaaaaatatatgctatccttctaccttgacaaaaatatcttcttaatggtctggagagccagatttgaattgagaatcatctgactccttaaagttctgcagccaaaaaaaaacacaaacaaaacaaaacaaacaaacaaaaaaaacagcggtacaggagaactagcacctgacacctgccctgtgtctaacactaggttttttttcacccctgaggctgttagcatcttgagagcttcaaacaaacatgtgtgaatgccccagcctgtatgttgaaactgtttacacatgctactcctcaggcccagagatgcccatataggtggctcaattcattgcaaagaggaaaaacccagggaatgaactctcacagaccagggcagagggcttggagaggaatgttcagagtcctgggtagggatggattccagacaggtataatatcaataggtaattatggcctccccttggccttatggaatccttgccacatgagtaggagtgagctagaggagggagagagaaccctccaacgtgcagagactgggtgtccttgatctaaggttcatacttactcagttcacagttagatttccataatctcaagtctaaaaggctcctatctaccaacgtcctttcttaaggtcttctgtttaattataccatggtctcgttctccttttatattcttaaaaagaacaagtcactaacacagtctgcctgggaacagtacactttttggtaacatcttagagcagaaaatatatttaaaaagcaacaatataaagaggaaattaattttctttttgtttcctaagtattacttaatacttacaatatatttttcctattacttatataggtattgccatcgacactttgtaagttgtagtaatacacactcataaattcagcagttaactcctctagctttgcacgtaatgctgttatttcttttaaaacacacggttatcctattacgcatgtgaagcttggaataaaatatatattaaaatatgactaaaaataaaaacagattttataggctttggaagtactatactttaaaagatctatatttttcacactgaggaaggagaactactgaaataaagtgtactgtgtcaaagtattacacacagaatatgagaatggcaatattgaatatccttgcccaactgtggaaaattaaggattaagatttgaggaaagtctaaatgcgttaaaatggaaaatgtaggccaggcatggtggctcacgcctgtaatcccagtactttgggaggccaaggcaggtgtatcacctgaggtcaggagttcatgaacagcctggccaacatggtgaaaccctggctctactaaaaatacaaaaattagccaggggtggtggcgcatatctgtagtccagctactcgggaggctgagacaggagaatcacttgaacccataaggcagaggttgcagtgagccaagatcgtgccactgcactccagcctgggtgacagagtgaggcttcatctcaaaaaataataaaaataaaataaattgaaaataataagcacaacattttgtcatttagttgataaatctacagtttagagtttgccatgagtcaaacactatcgtttcccaagtgaattaactttcataataatttgcctttttaaaaatgataattacccattccataatgggtaattacaggtaactatattttaaaagaactcactattactgtttatgtatctactgatttgaaagtgaaaatgtaaaaatgtttttatcaacatcaccaagatgtttttctacaaattctaactgaattgtattctactctataaactgatagacctttgctttagaaacttatgtggaaataccaatccagagaaatcctgtctccctatctcccacctgggactctttagaacctttagtattcacttcaaaacgtctgatatgggaattatagtgtggtgttctttaacttttaatatcacagatcccataatttggagcatcatgtaacattttgtagagctactattcctcagaacacaatttgagaaatgttctaatagagtcattttccacaaataggaaagtcctacaaatattattatactaaatcataatgaaaactagtctgatttgatgtattaattataaagtagtttagattactttaacttttggtgattattgccaaaacttctttcctattaagagtattctacaataaattaaatttagtccacatataatgctgatcatatgtacagtaacattaacatctaagatgacagagtaatatacatcttattacttttgtgaaaaatagaaagggttacataataaaatattaattgtctagaatttggctttctagaggcttgatatactgtgatgtagcccttaaaatatggatgttcttgtcagaaatgtagttctatattgggttctacttttgttgtcagtatgactgggacaggttactggatctctttaggtttgtttactcacaggtaaaatggtggttaataatatcttcctggaagagttgtgatactaaagagatggcctatatatgtaaaccacctggcacctggtagaagcattgattactcttctaccattcattttctttgaattcaattttttttgaggaagtacttcttggtgacagtgaagttccttaaccctcaagaaaaagagaaaactcagattcttggaggaaagaatgtagcactctcttttaccttgttataaaaggttaaattttcccttcagaaatttggaaggcgtggggaaaatttaagggagcaataaagaagaaaagcagaaatctgaacatagatgacaataaaaagaaatgataaatacatgcatgtacactcatgcatgtttgcacacacacatgcacatgtgtacacatgcccaacaaccacaaacacatccacaaataaaacaagagacactggccaggggcagtggctcacgtctgtaatcccagcactttgggaggctgaggcggacagatcatgaggtcaggagttcgagaccagcctggtcaagagaccagcctggccaatatggtgaaaccccatctctactaaaaatacgaaaattagctgggtgtggtggtgggcacttgtaatcccagctactcaggaggctgaggcaggagaattgctttaacccgggaggcagaggttgcagtgagccgagatcacaccattgcactccagcctaggtgccaaaacgagactctgactcaaagaaaaaaaaaagagacactgaaaaaaagagaaaattaactgtgatgctcactattcctgtgaggttgatttaactgctacctgcactgcaatttaatatgatgaacttaagagtacaaggcatctggaattaatctgaaaaattattattagaataatgacacttgaagtgttgacttttgactacaatggaatatttattaactagaacattctgcatacaggcaggaccttgtgaagcaaaatttatagctttgtgttcaggaatgattacaaacaaagatagcagaatcagggctttattagagtactatgcaacagttttgctaaatatatgttaaaggaatctgaaagaataaagagaatcatgaagattatcctaaggattctcctaaggaaattgagctttctgtgctacccagagaagggcccagatggtactggattcccgctgtaacttaaagggaagcttttacaatgtctggaacctgcgatgtcttgaaaatgaaggtagaggatgtcctcaagtttcttacagcaggaacccacttaggtggcaccaaccttgacttctaaatggatcagtacatctggaaaaggaaaagtgatggcatctatatcctaaatctgaagaggactcaggagaagcttctgctgaccgctcgtgtcattgttgccattgaaaactgatgtcagtgtcatgtcctccaggaatactggccagagggctctgccaaagtttgctgctgccactggagcaactccaattgctggctgcttcactcttgggatgttcactaaccagatcctggcagcctttcaggagccacagcttctagtggttaataatcccagggctggccactgtcctctcacagaggcatcttttattaacctgcttactattgctctgtgttacacagattctcctctgtgctatgtggacattgccatcccactcaacaaaggagctcactcagtggggctaatgtggttgatggtggcccggggagttctgcacttgtgtggcaccatctcccatgaacatccatgggaggtcatgcctgatctctacttctacagagatcctgaaggattaaaaaggaagagcaggctgctactgaaaaagctatgaccaaggaagaagaatttcaggatgaatggcctactgtagctcctgagtttgctgctactcaggctgaagttgcagactggtctcaaggtgtgcaggtgccctctgtgcttattcagcagggctctgctgaagactggagcactcaagactgccacagaagactggtcttcaactcccacttctcaggccactgaatgggtaggaacaaccgctgagtggtcttaagctgttctttcatagatactttttttttttttttcctcctgagacggagtatcaccctgttgcccaggctggagtgcagtggtgcgatagctgactacaacatccacctcctgagtagctgggattacaggcgtgcaccaccatgcccggctaattttttgtgtctttagtagagatggggttacaccatgttggccaggctggtctcgaggttcttaagctacatggcaataaggttgttggaaaataaacattattgtctaaagaaaataggaaagtgaaatataaagttatgaatttaaagctatttagaagggcatgaagaaagaccaaagaagtattcaaactgaaattattctaaaatgaaatttcaaattaaatttaatctagtttcacattgctgattaaattttagatgacactgtacaaagctatctgggagagtgaaaccacatgacaaatttactggttgtcattttctactttgtgattttagcctataatcagttttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagactagtttccgaggctgagcatggtgggtcacacctgtaatccgagcactttgggaggccaaggtgggtggatcacctgagagcgggagctcgagaccagcctgaccaacgtggagaaaccccatctctactaaaaatacaaaagtagccaggcgtggtggcactttcctgtaatcccagctacttgggaggctgaggaaggagaatcacttgaatccgggaggtggaggttgcagtgagctgagatcacaccattgcactccagcctgggcaacaagagaaaaaaaaaaaaaaagaaaaaaaaaaactagtttctttaaaatgtggatatcagttaaaatctgtgtattgtattgcattttgaatgcactggattaattccatttttaaatgaaacgtggaaaatcttgttttaagatgaagaatccttgctaaatagaatctctgaaccctaaaatggcttttttaattgggaattttcaaaatatgaatttggttagttacaacaaacaatcaaaatccttacctatgaattgccctcttctaaagcaagaatgttcaactcggatatctagtggtaaagcaaaaagagatttccctgttagtcctcttacaggttgtgggcattgcttatttgactttgaaacattaaagaagaatgtgtttcagggcagacatgttggtaaaactgtttctgttacaaaaattttagaggacaacccaacgttttaatgtggtgaacctcatttatcatcctgtcactgcaccatcttttttcagtttcatcctggaccagggtttcatggcacagaaaaaaacctggccatcaaatcatagcatatgaacaagtagatggccaaatgtttgaaagcataaacatgcctctctcattgggcactggttgagagggttcgaagcccattatttgtaattgcagttcagactaggagaaaaaaaactccatccagaagagaaacgattggaatgtttgtatggatttgggttttgatagcttctgtaacattccatcactgtttgtgtgagcattttccaatcagctgtcccaacatcaaagccatttctgcataatttttttttctctatattgcttgttcttttcaaaatttggttttctatccccttctcccccagtctcagtgagatttgcattttaatgtatgatctgtctaatgtattgtctatttcacttctaacagttacatctcttacatttacaaatgtacttcaccatatttcttccagacagtcacctttcttattattttactgccctcatgacataatattgtaactatctgcagctcttggacaaagagaacctttccagaagagctttcaactttttctcttttgccttggagtatgtctctctacctctattatgttcttgtaagtgataaatatcttatgagttttttttgtctatccataatgataatagaatctgagcattaatatttattttggtggaccatgcacaatttctaaaatccataatttattttcataaccaatattacagtaaattcattaagcatatacacggtttggaggcttattggcttaataggttcaattcatagaaaaggataattcactacctactcaaaagcatcctaccttgagagtcagctaagtggggaaaggaaaaatatgcttttctcttcagacagcctttgtatcagtgtttcagtaacatacatgactacttattgccatttcatttcttctctttgaatattgcctttgcctctcctgggacagtagagttaatcttataggaatacctaattccacgaattccttagaatagtataaggctgtgcagtgattggcccttaccttgctctctggtctctccttccaccaccggcttctgagaggttcgcagtcttacatcttgaaaaccactttcagtttgtgaaatggaccaggattcttctttttcttttctttttctctcttttatttttttttttgagacaaggtctcacactctcacacagactggagtgcagtggcatgatcattgctcactgcagcctctacctcactggctcaagcgatcctctcacctcagcctcctgagtagctgggaccacaggcatacgctaccatgccagactagtctttttttgtttgtctgtttttgtttgttgttgttgttgttgttgtttagagacaaggtctcacgctgttgcccagactggtcttggggtcctgggctcgagtgatcaactgcctcagcctcccaaagtgctaggactgcaggtgtgagccacttcactcagccagaccaggattctttcaagttttggtgacattacttatatttttccctatttttggaatattctccccatctgattgcactggaacagctttctaacatttttttcaaggctttgttaaaccataaaattaaaaaaataaaaaaacattccttgagattaattctcctggctgtgttgtgcaatccttctaggtgcctgcatgctctgtgcttatctttaatgataataaccctttatgtgttttaaatcatttactcattctgacaagcatattcagtaaacaactgtagttatcatcagtcctattttatgaatgtagaaaataatgcaaagaaaattaagttacttacccaatgtctcacagctaatggtagaacaaattttgaagaggtctgtgacaggactgtccattagaagtcgaatatgaactaaaaatgctatgcaatttttaaaaaatttcaagtagatatattacaaaagcagaaagaaacaggtgaaattcattgtactgttattttattctcaatatcatttcaacatatgacctataaaaatgagattttttttatttcttcacactgagttttcatatccagtgtacattttaaacttaaagcagatcttgattcagactagcattctagaacacatgtgcctaattgctacctttgttcaacagcacaagtctttactcttaattacagcacccctctttgtattgaaatagttttatttgcctacctgccccattctactgtgtgcatctttactaggtgaagaatgtgctattcatttctttatttcaagtatatagactagttagtgcctaagatatagaaacaataaatgcttatggaattttgttgctgcagtattgcagtggcttcagagtacagagatttttggatactctttttagcaatcattgtagaattgaaaatctaaaagattcaaaacgcttgacaaaatttctagaaggcatgtatttgcctgttagacttctgagcaggtcatacaagaagattgggaagctatcctggaagttagctgtagcccctacagacagtagaatatgccaagtttccactttaagagtgcatgtaaatgctatgacttttactaaaaccacatggcaatataataaatgaaaatgtggtctaaacgtgttctggaacatttcctaattattataacatattgtattttgttatcattatttagtagaaaaatgggatcagaattagcattgtaatattattttggtaaaattatgaatgggatcatgcctcatacatagtagatgcctaataattattaatctgatttgatttatttgagccagggttagtaagttcaacttctactggtttctgttatttatttgagaacctattcaacttgccatcattgggacaagctgggacagttccttaaaatgaactctattagagtcaaattgttccatctgttttccctaaatgaaagaagattcccttgatgctagtcaatgagtgagggctccttgactcagaaccagatgcaagctttataccagccttccatttcagcccaattacattcttggcagcctgtgagactcatggggtaaactttttataacaattatcaatatcagccaatttttcagaatgggcaggaataaacttcaatggctccaggatgagttttctgtcttccaaagcctctgtctggctggctgccatggagaatatgtaggagcataaaggctgctgttttatgtaacactctagaaatcagctaactttatgactacttagagttttaggattttatcaatctaaattaattatttaatattggcttaggctacttttttgtgacatagagaacattatttttattcctgtgatacagacctccaaggtgtgtgtgtacattacatagcaatgactggagtctggtttattgttgactccctcataaagctattgtggacgaaagagagaaagcatcttactgatgggatatagaatcagtgaaaacctggaaccattgaattcccattgggttagtgtgtgtatattaggatgggaggtttggggaagtagagtggaaattgatggtgttatgagatgacgtcgtgacctttaactcaggaatgactcaatcctgtcaatatctaacaatccctatacattgtgatctcaggtagattgttttgcaatggcaatggcaattatgaacacacactattattcactgaatgttcataatcacaaagggaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaatctgcaccctgaccatgtgatagaaaaaaaaaaaaaaagcccatttaacagggaggaattcaagcaggtggcagaaatttgcataagtaaagaggagccaattactaatagccaagacaatggggaaagagcctccaaggcatttcagagacatttgtggcatccactcccataataggctcagaggcctaggaggactgaatggtttcatgggccaagcccagggccccactgccctgttcagccttgggacactactccccatatctcactctgctccagctccagccagaaaatttgcagcctagtcatttggtagaaaagaaaagccatttgcaggggaggaattcaaacaggctgcagaaatctgcataagtaatgaggaaccagttgccaatagccaagacaatgggaaggccttgaaggcatttcagagacctccatggcagtacttctcctcacaggcccagagacttaggaggtctgaatggttttgagggccaagtccagggccccacggacctgtgcagccttgggacactactccctgcatcccagtcacttcaccactagccatggctcaacaaggcccaggtacaactcaggccaccacttcagaggatgcaaactgtaagtattggtggcttccaagtggtgttaagcccatgggtgcacagaatgccaaagctgagccttgagagctcctgcctagatttcagagaatgtatggaaaagcctggatgtcctggcagaagcctgctgcaggggcagagccctcatggagaacctccaggaagccaatgtggagggaacatgtggggttggagtccccacacagaatccccagtggaggactgtctagtggagctgtgagaagagggccaccatcctttaaaccccagaatggtagatccaccagtagctttcacatttagcctggaagagccacaggcactcaacgccagcccatgagaacagttgtgggggctaaaccctagaaagccacaggagtggagctgcccaaggctttgggagccctccttttgcgtcagtgtgacctggattgagacatggaatcaaagaagattattttggagctttaagatttaatgactgcttttctgggtttcagacttgcacagagcctatagcctctttcttttgaccaatttttccattttggaaagggaatatttacccaatgcctataccaacattgtatcttggaagtaactaacttgtttttgattttacaagctcatatgcaaaaggaacttgctttgtctcagataagactttgagttaatactggagtgagttaagactcggggggactcttgagaagatatgattgtattttgaaatgtaagagagccatgagatttggaaggtgccaggggttgaataatatggcttggatttgtgtccatacccaaatctcatgtggaattgtaatctccaatgctggacctaaagcctgatttgaggtgattggatcaacagggcagattttcctttcgatgttgttttgtgataatgagtgagttctcatgagatctgatgttttaaaagcgtgtggtacctctccactttccctcattctgcagccgtgtaagacatgcctgctccccctttgccttccaccataattgtaagcttcctgaggcctctccaaaagtagaagccactatacttcctgtacagcctatagaactatgagacaattaaacctcttttctttacaaatcatccagtctcaggtatttatttgtagcagtacaagaacaagcaaatacagagagccaatgcatcacatggccagagtagaagcaaaaaagttaggggtaagatgccacacatatttaaatagccagatattgtaagatctcactatcatgaggacagcaccaaggatatggcactaagcaattaatgagaaacctgccaccataatccaatcatctcctaccaggctccacttccaacattggggaatgacattcagtatgaaatttagagagtacaacatccaaactgtgttaatactgttacagaaatactcaacaaaatactaacaaactgaatttagcaacatgtttaagagattatacaccatgacccactgggattattcctgtgctaggatggttcaacatataaaaatcaatcatgtaatacactacattaacagaatgaaagataaaaattacatgatcatcacaattgatacagaaaaaatcatttaataaaaaattaataccctttcgtgatgaaaactctcaacaaactaggaataaaagaaaactatttcaatatattctaatccacacatgagaaacccatagcacacattactcgcaatggtgaaattgctgaaaaattgtccttgaagatcagaaaaatgataggatgctcacttttgccacttctattcaacatagtactggaatttctgatcaaggaaattagccaagaaaaagaaataaaagccttggaaactggaaacaaagaggtaaaattacttctgtttacacatgatgtggtcttagaaaattttaaagatttccaaaaagtttgttagaactaattaaaaacaataagcaaagtgacagggtacaaagtcaatacacaaaaatcagttgcattttgatacactaacaaacaacccaaaagaggaaattaagaaaacagttctatttgtagtagcaccaaaaggattaaaatatttaagaatttagttatctaaagagataaaagtcttgcatacaaaaagctacaaagcattcctggaaaaaaaagatatatattaatgaaaagctattccacatacatggattgagagacagtattgttaagatgccaataatgtccaaaacaatatacacagattaatgtagtccttataaaaatcccaatgattttttgcataaatagacaaacccttcctaaaacttatatggaatcttaaggtatccaactaatcagtacaatcctcaatatagaataacaaagcattgagctcatacttcatgatttcaaaatttactgcaaagccacagtaatcaaaacagtgtggtaatggtgtgttagccctttttttgtgtgttgctattatacatataaagacatacctgaggctgggtaatttataaggaaaatgggatgtataggaagcatggtgctggcatctacttggcttctggtgaggcctcaggaagctgtcgatcatggcagaaggaaaaagggtagctggcatctcacattgtgagcaggagcacaagagtaggggcaggtgccacactcttttaaacaaccagatctcatgtgaactcggagtgagaactcactcattaccaaaaggatggcactaagccattcatgagggatccagccccgcaatctagtcagcttccaccaggccccacctccaacactggggattgcatttcaatgagattgggaggggagaaacagccaaaccacatctattggcataacaacagacatatagaccaatggaatagaatagagggcccagaaataaattctcaaatatgtggttaacttattttcaacaagggtattgagacctcagtgaggaaaagacagtactttcaacaaatgtcattgggaaaattgtttatctacatgcaacagaatggaatgggattgttaactaaaatgatgtttaaaaactagttctaagtgaatctatcacttaagtgttaaacctaaaactataaaacatttagaagaaagcaggacaaaagcctcaagatttgggtttggcagtaatatttcttggaaatgacatcaaatgcacagacagcgcaagaaaatatacacaaattggacttataaatttttttaagtgtgcatcaaaagacatcatccacagagccataaggtaatccatagattgggaagaaatatttgcaagtcatatctatggtaagggattaatatccagaacatatagaaaatgcctacaactcaacaagaattacaaaacaaacagcataattgatagacaaaggagttacatgaatatttttccaaaaagatatgcaaatatccaataatcatgaaaaaagatgctcaatgtcactaatcattaggaaaatgcaagttaaaaccacaatttgataccacatcacattcactatgatgcatactatcagaaagaaagtaaatagaaaatatttggtgatgacgtggagaaactgaaagtcttgtgcactatttggtgggaatgtaaaatattatagctgctgtgggaaacagtatgatgtttcctcacaaaattaaatgcagaattactgtatgatctataaattattcttctggataaatacccaaatgaattgaatgcacggtcttaaagagatttttatgtacccctattcatagcagcattattcacaaaagctaaaatgtggaagcaacctaagtgtccattgatggatgagttggataaacaaaatgtgggatatacatacaatgggatgttattcatccttagaaaggaaggaaattctgacatatgctacaacatggatgaaccctctaaggttcatccatgctaagggaaataagctagtggcaagtagacaaatactgtatgactttatttatatgaggtacttagagcagtcaaaatcatagacacagaaagtaaaataatggtttccaagaagtgcagtaaggaatgaagagttactgtttaatgcgtacagattttcagttttgcaagatgaaaggggttctgaagataggtggtggcaatggttatccaacaatatgaatgtacttaatactgctcagttgaaaacttaaaatggttagtatggtatatgataaattttatattgtgtgcaatttactataattaaaaaatgaggaagaaacacagtttaattttaaataaaaacacacatgtatatatatatataaatttttgatgtgataaaatatggtctcccataagaccaggaggacttaatcaaatttgctccagctttatgaccttctttagcccctctgaaagtcatcactccatatttgctgaggttcgaagttgggtgtgcaccagtctggtagagactagctccacttttagccatatgctgttgtgctgctaccatggtttctcacatttgttaactgacactgacaaggctgaaagaagcagtggcatgcaccttgcaggggagacatgaatgcgtccacacctgaatttgccatgttcagacctcagttatttcccctaatagaacaaattctgatagtacgaggaatgttgagagctaccccttcaactatagcctctgggtgctgcaggccataaccaggtcgggtgtgtgctataagggggtggagatcaagcagcaccatcccctggggcagctattaaaattttcacttccaaattgtatttaaagtctgtctcccattggaattctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacccagggtacttttagtaagatgagatatgtgagccataaactgtgtctaagaagataaagtatgaaaatatatgttcaaaaggagctaaacaactgcatgcttcacatttgcctccagtaattcaagaagagatgaagtgcaattactcatatgcccctttcaacatactactgtgggtcaactgggtccatcatagaacagtattagggaagatcttctatgtcatgaataaagagttgctcaactgtggcttaattatcatttaatagtgactctcttagcttcataaagtacattcttcaaagcttgaagctaagtagaaaggcaaaagaacacacaggttggagggtaagcttaaggaagcagtataagcatcgttcattcattcagagataaccggtattgcagtaagtaggctggacttggaatcgtaattcaggagttttagttgctgattcttcactgggttcaatgaggcttttttgatgactttttcatcatggatgaaatgaagtcgttggacaagatgacctccttggttccgtccagctctacaaaacattttggagccaattattttgtcgacttttttctcaggggtcctttatagaaacagtgtataaaatttactgataaagtaattaactctttttgacagttttccttcagttagattaatattttcagggttcatctatcttgtactatgtatcattatttcattctcttttattgataaaaatacttcattatatgaacatatcacctgcatatgattaatgtatttaatattgtcaacttattcagaatataaatactatttgtagagccctatattagtagaggtaaggatgagaatattcaaattaaatgagaaggattacacatagcaactataacacaagaacaaaccatttttgtttcaaagttggtaaaaagttaaactttacttggagtagatgaaacaaataccaggcaaatggcacattgttttgtttcatattacaccagtagtttcggttttacagccaaaatatatctaaagttttgtatttgaaacttttgtcatctcagttgtttccgttttggtcatcactattttttcatatacctttaaaaaataaatttattgatataaaatcatatagcataaaattcacccttttattttttaaaaataatttttattgtgtctatttaatgtatgtatacatcataatgttataagattatatatatatatatctgcatacatagtaaaatagttagtataggggaacaaattagcatattcatcatctcacatagttacccattttttcctccttgtgataaaaacagctatgaaatttgcctttttaaagtgtacaattcattgtttttagtatattcatagaattgtctaaccatcattgctgttcatttctgaaatgagttcatcatctccaaagggaaatctagtacacagtcatttctgattttcctccccccagtctctagcaatcactaatctactttctatttctatggattttcctatttgaacatttcctatagattgaattatgccatatgcagctctttatgactgtcttctttcagttacattcatatttttaaggtttattcctcgtgtaccatgtatcattccttcattcatccttattgacatataaataccaatattattatatggatatatcacattttatcaattaatcagttcatgatactgggatggcttcctttcatcatagccttactaccttaacatcttcttattttttcttttcattatgtgtgggtgattaacctctgggattttactctattcttgctttgttgtctcatccagtttatatatgaattccaaaatgctcaaaatgggaatacttagacactaattcaatgagatacataaataccaaatatatactcagtcttattcaaagtaattgggtaaataaggaaattttaatattttcttctaaaaagagtacacagccattttgatggttaatggtagtatctgataacaggatgaaatgtaggtagggtggagaattaaaaaatgcttactaaatcatggtagttacgttacctccatcatcatcatactcaagatcactttattggatacatactctgtggaaggtacttcatttttaatatgtattatagtatttgatattaaaacaacttattttggacatgtaggatttttaaaaaattatttcagatgacaaaagtaaattacagatagctaatgtaaccagctccaaaattaaatactgttatgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctgtgtgtgtaaaactaatattgtttgggaggaattcataattcatagaagaggtggactttcaaattgcccatgatgttagatgaggaaaatttggttaatcgtgatgagaagtgaggcagggtcactagtttgaagaaaacaaccacagcaataaaaaatgtactctccacattcatgttctaacactgattgatgttaagttgtaggtttagagttcagccttactggcagacttacttgtaaattccgactgctccttggccaatctgattattcttaacaactcaacaggagacttgaaactttaatggagatttgtgattctcccagggcgtatatctatatcttctcagcagtgtcagactgatctgctgccaacatgtttttccccctctcagtaaaataaatctctgactacacatcctggcaaaagcacacatttctcctggcaagcttcctcaatgggcatcgaatatcttgagatttcagacaaaatcatttttctccaggggaaacatgactcgtgtagatgacaggaccccagacaaacagcaaactctgctcagaattttaacaattactaaaaacatatttcctatcacagactcatttttttttgccaccagtacaccccccccccacacacaaacacacaggtgcacacatacatgtgcacatagtcaattttcctgtacttacctgcattatgaaatgccaaacttatggtgagtttggagaggcaattttttttttttacaaataataccctccataaataaacatagttattatgaatgcacactcattgtgtaatagatctgtggtttgtgtcacttagccaactttgatcattttctgtcatccagaaaataacttctttcttaacaaccaacacataatcaatgcttggcagtaatgggcatgtgatttaggtttgtgcctaattagcacattgcataccactaatgtacagcacaggaatgagtacctggaccatctatgaccaatgaaagcaagggacctcctactgagaaccctggaaaatatagttttggtttttttatgttgtcttgaaagtgacaggctgtagggattccatatgctatagtcattttttgatcatgaagagaaagcttgtctgaatggagccatctgaaagaaaactatggtaagatattagtcatgcccctgatgacaacactgaagtatctgtatcaagtcatgcatgtctgcatgaagccctacatgcagtcagccagttcgggaggtaatctcattcaggcaggagtttctgatacttcaaaaagcaataaatagtcctttagttttctcccacctcctacctaaaatagaaaatggtaacaatgacttatctatcaattcttagctgatcatccttcttctaaaaacattaacttgtatatcgtgtcacgtgcctgtagtcccagctacttgggaggctgaggcaggagaatcgcttgaacccgggaggcagaggttgcagtgagctgagattgtgccactatactccagctgggcaacagagcaagactccatctcaaaaacaaacaaacgaacaaatattaacttgtataatagctgtttacagttaggtaagttacatcctgggcataagaacaaatatgattaagtccattatacaattttaggctcatcagcattttttcttaatcatctgaatttttctcataaactttaacactgttccaaaaaaaaaaaaaaaaaacaaacaaaaaccttaaagcctacatatgcttgagaagttattttatccaaagaaaaacgacaacctattgcccaaagttattgcctcatttccacttgctattaccttagaactaactagtgttttgatattagtaaccatcctataactatttctttgtaagtattttcatatattttatattcgtgcccttcattcttgggtctgattgttgttaagtatgtgaattttaattattctttctgtcacttcttttaatgttgtttctgtttaaatgaatgcaatactaccaatttattcaactaaatcaattttctatttaattaagtcttactttatggtttaattatatacttggattacagtgatcaatcttctctctagagatttaactgaaatatgcagaaattgataaaggtaaagttatgtcattatgcatttgaagagtcatagcatctgttgtttagatgtatgaattagttttccagacaacaaaattcttcaatactactctatgcaattatgttgagaactataacatctattaatatgttccttttgtctacattttaaatacagccactttttctttgtatatttcagttatgatattgcaatttatttttctttctataatgtcaactgagagtgttaagcttttgaaatagccaatggtgaatttttagtgtttagtgacatagtataatgcctaatctataattttaaggaataaagtctgatctaaaccttgatatgttcatgattgccactgtgtattttataagggaacatattaaaattatcagttagtttcccttgacatgtttgcattacacaaattttccacagtggatttatattattttaaaatcggaaaatataaaaaattattgtctttgacccatatgtctttttcttctatcaccttttgtatgtcaatatgctgatattaaccatgactacagaaatattttcataagggtgagaaaacttgcttaagttttactggcactagtaacatatccatctgtccattcaactgaaatgctaatgagaagacattgcatcttgaaaagaaagacatagctttatcaaagatgttggagattaaacatgtttgtcaattggacaatgtcaacaatgcagtttagatgttactttaaaataagctctattttctgcatgtatcactgcagtgtagagttctagacctttgggatcatataaacacatcaatctttatatttactttatatgagatgctcaagtggaagagaagcatgaatctgcttacatctttcctttgcctggtgatttaaatagactggaccattcaacaagagtgttgagtgtatgagtatgaagtctagaaacttttggtaagagttttaactgaagaaagttaatcagttaaagctggtggttatgctactattctgcaaacaacccttctggtgggaaaatatatttaaaattctagagagagattttattttcctcttatgctatctttttgcaaataatccaaagaatgaaatggtcgtgtgaaaattgctgctattcacattttagctacaaatcagaaaaacatcatttagttgagtggctatcaactgctccattatctagcctgaaaaaggctctttatcacaggaagtaccattcataggatcggcacttccacaagaattaataatgattacttacaattatgatgacttttaaataaaaacgaactttattctggttactttttaggtaaatgcttttattttggatatctaactttatcttatttaccagggatttgattcattttttaaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtagccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacattaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaacaagacatttatacagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgcggagaaataggaacacttttacactgttggtgggactgtcaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactcctgggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaatatgtatctctcatgccatgttgtaaaacaaacaaacaaagaaacaaaaaacataccttttagagtgtatggctattttggaaatccaaaagaacagtcttttagttacattgcaatgatcggtgattaacgtttaaaatatagtaagtaaaagatatcttatttgaatgaggcaaacaattaataggctaacacagattccagcaaactttttatttaaagaaccagagggtaaatatttaaggctttgcgggccatattttctctgttgcaactactcaactatgctgttatagtgcataagcagccatgagcaataaatagatgtagctgtgttctttacaaaaacagttcttagaaagccagattagcccaatgctgtagtttatggacccctgatctagtatactgtaaaccaaaaataaaaccctaaggcccccaacagaccaaacagactctctcttggccaagaggaccccagaaaaacctgaaaacctgaattcctggctgtgatgggaagggatgttgaaccctcttctttatatctccttccttttggaatttaagcacaactgaccagcattcaggttaaaatagagatcacaagaataacaaaacagtccctttgtggctaattaaaaacaaataaaaggccatgcaaggcaaaggttaagtcccatcctacaaaccaaaaaattttgtaaaactggcgcttttttttttttttaaattaagctggtacaatttgacttaatttctaacctaactacagatagcagaccctgaaggaaacaaacatattttaccccaaaatatattttttgttatattttgaaatggccccacaaaaccatcttttgtagggaaaatttggatctgcagacaatctctattaatgtaaccagaccttccctttcccaagcctttcccagatctaggggagattagctgacagtctgacaactttaatgtctgaaaagagacatttaccatctattctctctgaggcttcatctgcataaaaagagccttggcctttacaaccccctttaatcttgattcaagcatttatttcttctgacttcaaatatttagacaaagtttaactcttgcaaccaattaccaatcagaaaatctttgaccccactgatgacatgtaaaccttccccacttcaagatatcccacatctttaggctgaacccaggtacaccttccttgtatttatttatagttgtattagcctgttctcatggtggtataaagaaatacctgagactgggtaatttataaaggggagaggtttaattgactcacagttctgcatggctaaggaggcctcaggaaacttacaatcatggcagaaggtacgtcttcacagggcagcaggagagagaatgagtgccagcaggggaaatgccagatgtttgtaaaaccatcagaccttgtgagaactcactcgctatcaggacaacagcatgggggaaaccacccccatgattcagttacctcctaccgggtcccctgacacatggggattataaggattacaattcaagatgagatttgggtggggacacagctaaaccatatcaatggttttacctacaattccgatctccctaaaatgtgtaaaaccaaatggtaacccaactcccttcagcatatttctcagtacttcttaagaatgttccctgggccatggtcactaatattggctcagaataaacctctttaaagtattttacaaagtttatttcttccattaacaatgctaagtttaaatttatatatgtgtaaatgtattaaaaattatttaaatgtaatattgtaacattatgaaagtaggttatgagagttgagatttgcaagatagtattaaaaaatattctgacactaaaacactaaggaagaccttattcaaagcaattgcgagagggctgtgcgtggtggctcacgcccatattcccagcagtttgggaggccaagattgtggatcatttgaggtcgggagtttgagaccagcctggccaacatggtgaaaccccatctctactagaaatacaaaaactagctgggtgtgttgactcacacctgtagtctcagctattccagaggctgaggcagcaggatcacttgaacctgggaggtggaggttgcagtgagtcgagatcccaccactgtactccagcctccagcctgggcaacagagtgaaactttgtttgaaaaacaaaaacaaacaaaacctcccccaaaaaacccataccaaaccaaacgaaagaactattgcaatatagagaagagacttaactccaactacagcaaacactgctagaggtacttagagccaatgagcagaataatgcagtcaatgcatggaaaactactaacaggaggtatccagggcagggggagtcttgctaaactggtataagagttatagaggaaagaaacacgaaacacggctggcagttaaagacaggttttctttagttgaaacctgagaggtgctcctggctagtttgtcaggagccctttctcttacagactgtgagtatatatttgttttagggtgagaaggcttaccagaagcttggaatgtttatgtgtgtggataattttatggtgggctggaatgtctctgggaggagaggagattatcttggggcagacatctcttcagccaggaggagggttgtctcggggctagcatcttcctggctggaaggggttatctaggggctagcatgtctgtggtcggggaggagtttggaatgtttctggttggagatgttatttgtggtttatggtcatgctgaccttagccattaggctgatacactttggatttaggtggcttttattaggttgaactttagaatgaggggcatgtccaagatggcaatgctcctgctctgtcaactggattaacacaatttttgctaaaggcaagccatagacttaaatttcaagggtaggggtagaggaatttgatcaagtgtcaaaggcaggaggattctcactaaactgacccagcaggattcttgttaaaggcaggccaaggtcaagggctagttgtgaagtagatggaggagcctgaacaaattttagtcaaggcagatatcttcatcaggagtgctaaatgcatttctaaataacgtcacaacagcaatcaataaataaataagtacatatatatatatgatcgatgtggtcaaaaacttagaggaaacaaaaatatttgctgtgatcattctactggatggggctgtagtacatactctaaaagctgtgaatgactgaatggtggctcaccaaaaattccaccaaaataacctattaaagataaagcatggctgacttaattgcttagtttggtaaaaaagatcactcttgtcacagaaagtgagcagcatatggaaagagaaaagcaaagaagagttgcttataaagttttgggggtatgtagtttgacaggtatttcaataagtggtcttgattagagttgggcatactttgtgattaagagtttaggataggtgaattgagggatgtgagtgctttggagaagctcttaaataggaaacagtcatttgtttgtgctgtatgttgttctgagaaagatatatttatgagccttagatgggcggtctatttttcaagtaaatgggtttttggaaagttcttgaaaaaaaagaaggttatttgcaacttcagcttcctggaaagaatttcctgaaatattaaagtcatatcaatgcagacagttgaatagcaaattgtgttaatgtaaacagtaagatgtgttggtatagatcgtttcaattctcaaaggaacaagaaataggttccttcttgagtttataaagtaattgaaaacccaaaacaaacacatcaaaatggaataaaaaaactcaataaaaaagatcgaaaggaattacatgattaaatattaactggcacaggagttcagaagagagggatattaggtgaatactttaaaggtgttgggaatttaacaatgctttgaaaaaagtgaaaagtttggacaagatctggtgtatttattagtgggcattgtaagaaaatctgagtgggagtgaagttttacatatgtggagaactgtaagccacagataatctggactattttataggctatcggtagataataaatatataaatatatgttaaattttatattttattattaggaagccacaggtctttgaggagtgtttgagataatggtaagtattgtgttgaattgattgggctgtgtaatggtaatacctagagccatagaaaactcttacaaaactagcagtagtctgggtgagtggtcataaagaacaatataaatataggagatgaagatacaggaaaggtgtaaccaacaggatggtatgtatgtaaatggaattttgagggagagtagagccaaaactataaaaagtttaattgtagtactgagttttatatgtctacaagatatgtgatctagcatagaattagaaatatagaactggcctatgggaaatgtcaggacattagttgaatgtttaagaatccatataagaaggtgtgagtagtaaaatagtcactgaagagctgttggaaaaaaaaaaaagcctacagctgagtttggaaggatgcctttgtttagatagcaattgagaggaaagagcatatagaaaaatttgaagaacaaataccagggcaagatagtggttcaaagtcaagagaagaggattgcaaaaccctactgttcatcatcattgttacacactatgaagttgagttaggtggatattaaacatgggggaagaacatattgtatttggttattgcaggtcagtgatgatgctggaagtctgaaatttcagtagagcaaggactgcagctgtactgcagaagatacagagaatagcttgtatggctgttatggagaacaaggtggaaacccctcaggcaaaaggtttattgaggcttactgtgaaagggaaaaaactaggaacagagaaaaacaccagacttaatgtactttttatttatttatttattttttgagacagagtctcactctgttgccaggctggggtacagtggtgcaacattggctcaatgcaacctccgcctcccaggttcaagcgattctcctgcctcagcctcctgagtagctgggactacaggtgtgcaccaccacggctaatttttttatgtttagtagagacggggtttcaccatgttggtcaggctggtctcattctgttgaccttgtggtccacccacctcgacctcccaaaatgctggattacaagcatgagccaccgtgcatgtactttttttctttaatccttttgttttttgaagcagaaataaaagatatttaagagcttagagcgcattgacttgtttataaaacagagcttctctttgcgaaggagaaagttcatctcttcccaaaagtcttgggaaaaaaatgtgcatgcaatgagatcttgaagtagaaataaaggatattgaagccatttctaatggcctcagtttcttcagttaaatatatggatcctggggctcttcaaaatatgaggaaagtttaacattgttgtgagcagtgttttagggagttgaattaggagcctactgtgttttaattgtgagtagctaaatattctagatttaccattgatatatttaattaaagaataaaatcttgttgtttaacaaacccttcctagatttatttgagcatttcctgtgatagtcatttcattttttccacattttatttttaattgctcagctttttttattgagtatagtttcttttaaaacatggaatgctacagaatttcaattgtggatatatcaaaaatagttttaaatgaagattatgtttggattaaagtttctcagagaactgatttgccagagttttttctactttttgaaaactctttctctatgtagagatagattatatatttattgatttaattttaaaacactgaaactagattatcacgtcaaaattaaatgcatacttaaattagccgttagcaagaccaacagaaaccaatatggtgactttttattgttacatatggaagatgaattttgtcggatttcaacttctcagaagactcacagcataacccgttaagcaaagctgagtttattacctataatagtcagaaaagacaacattttacaagagtcggagtgtccagaaggagaggattaaggcgaaatatgaatagggttggaaatctaggtttgagtagataagactgaactttcaatgtgaggatctggtttggttaggcacatttcaagacgtaatagtttaggattggtgaacacagaaaggcaggaatcttgaagtgagttgtttgataattgagccatttacccagttttaggagtttaatgtttctagaaactaattttcagccattttctgaaaaaaaaaaaaaaaaaaaagtttttcgttctgatttacaacgttaagttcataaacaagaacttcctagaacaaacagtaaaataatgtgaatgtaggctgcctttatttttggtcctgatagataaggtggatgcagaagtctcagttcttaatttcaataccacattgagaactaaattaacaatggaaaatgctttattatctgctttgtgtggaagaggtataaaatataaggctgcatttacctgaaagattttaaattaggatactatgtttttctttttgtcagccaaattatgggaaaaaaaattggatcgaaatggcagtaatgatagttagggttactgcagactgaaaatacgtgcttagatctcagggtacacaggccagatagtgattctattctgccatacattttcattttaggaaaactgactgagtcgaatgtgtgttcagaataattggctcttaactgtcaaagagttaaaaaggagaaaagattatttaatcaaagtaccttgtagatatgcatagtgccatgctttaagaatatttcaagtactcctaccttaatctttccatgttaatgcacttaagtcattgatctgattcactcatatttgattacttaaagttaaacaaaatatatcatacaacatttagaaatgtagttccagaatgaaggatcactattagtctggtagataactgttaatctagtaacaggagtttcaaaactggggattccactagtgattataaatcaaactgtaaagtaggataaatatgaaatccagaagaccagattataaagaacaaaaaaaaccccaagaaaattaataagggcagatattagtttcttttaaaataattcatgcaaaaatctttattatttattaagctagagaattacatgtgaattttaaaagtttatcctattaatgcaacattgagagtctaacagtaaaatttgcaggagtgtagatctaaaggtatttacaaatctcaattctctgtagatttttctcaaggccaaataattatccaagaaaattgactttaaataaactgatattaagtgtagtctttatcttttcaaacaagcttcacttccttctactttgttctaagggaaatcatgatgaattttctttcgatcacccctaataacaacctatcactcatttaagattttctttcactatgaggaactatggggtcacgcatttctttttctcttctcttgactaggaatcaccattcatactaaaattgctctatggcttttctttctctctaacaccacagacctcatctcaatttaaaattctgcattgtgcttgtgtactcacccaatgatttcttcctatccactgcaaaaaccagttcactgagacgttggtattgcagtaaagaagagtttcagtaacatgagattagccatgtgggagaactggagttattactcaatgagtttccctgaagtcttggaggtcagggtttttcaaggaaagtttggtgggcatgggactagggaatggatgctgctgattggttgggggggatgcaattataaaagtgtggaaaactgtgcactgagtctgcctctggatgggaggtcacaggactggttgagtcatgagtccaggtgaggccagtctgaaaatcatctcagaagaccaacctgaggttctacaacagtactatcatctatattatctatatataggcgagtcacaaatcttgtgacctctggccacatgacttttgagcagtaagggattatagaaactatagctacattttaggagaattcaggcctctttcataatttcagttttgtgtcctttcattagtattacaagggtggtttcaacccctgaacgaggaggggatgaggtttagggagggactattattattcttgtttcaaggttaaactataaactaaatttcaccaatggttcgcttggccaatacccaagaatgagtgaagacagccagcctacgagcctaaaagcaagatggagtcagccatgttagatttctttcattatcataatctttgcaaagatgtttttgcctgccttttgagagaaaagctacttgtcgagtgttttgttttgttttgctctatttatctccatgatgcaatggaaaatggaaatttattttctcttaatttattgagaaaatattgtaaggatgattttgttagggcatgctatttggctcttgataattcatgatgatatgttcatcacaatcaagaagtgggccagagatgagaatattttaaaaaattcatagagggaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaaaaaaaagaacccaattcctttttagctgataaaagaagttcagaaggtgatacaggccttaatttaaagatcatatagaactatcagtccatacggccagcctcagggagtaactgggaaatcccttctttatctccttactttcctccttcctaaaaagtccatttgactttccctgtttcccaggccacagttccaacatgtcactgttcccatgtgattaaggtcaagaactactggccctctgtgttattcttgactctaacaggagagtcatattggactatgtgttttgaattagatactgaagaaaacaaacttcagctttgctaatatttcttgcttcttgtcatataaattgtacgtgtaactattaataatatttaaataatgagagaaggggtcagaaaatcttgttctgccaaaagtgtcagacaccttttcgtgtgtttttgtggctaatctttgtaactcatcatttagtacttgttttataactttgcaagtggagacattcagtttctgagagattgtaacttatacacattcattcactataagtagtgaatctaatctccattaatatcacctttcttcctagaatgagcaggagattagggatgtgtaagcaagaaaaggctagaattgggtaaaattgggtaaaaagattatgatttaaaaagagaacatattcaaacctactttaatgtggctatcttctcttttacctaatcatatatatatatataattatgtataattatatatatatatatatttatctccagagtatccttatatcctgtcagttttacctcgttagtaatttcaggcagagatattgttaagatgttttaattttctaacaaatatggccaaacttacctcaaaaatatgtaaaagcaattatctgaaagaaatgcaattatttaaaatgaagacatagttcttctagagttgaaaaagttcattcattgatatagtagtagcctcagattttgagctgcaattgtgcaagccaggtaaaataccacagaaaaaattcacaacccagaagagaattcaagatgctgaataggaattcagtggtggtagaagaattggatccataaataggtctgcatgagaatgattcaatcttaggagacatagaactgttagagttacagtcaactggcagcacttttaagttaaaatactggatcatcatcagtaatggtttactttagagactggaggcacttctctttgcccattttttctcaccacagaatgtgcagcagactgcccatattttaattaattttcatttgttaaaccatgaacctgagtggccctcatactaaccccttgttcattgcacaatagaccatgtgttaggcgggcttcctgatctttcacgagaatgaatgccaagtacagaaatctgcttgggttattgaaggctaaaaatgattattctaatgtgtctgtttattttgcacgttttctcccctacagttactatattatctagtcaatgtatttgtcaattgtgaatgtctttgttgttgcagatacagatgtggtgtataaaagcgagaatggacatgtcattaaactgaatatagaaacaaatgctaccacattattattggaaaacacaacttttgtaagtaatgaataattaattactttatgcatttcagtactgtttagaaagctctctagatgtacataactttctattcttcagctccagcatttgtaaagcatttcaggtgaaaagttggggctggaatatcataagaatcagtaaatctattgataaaaaataccctgtgactatctgcttcattttcttcccgtttactcttgttaataattggagaaatatttccaaaaatagtagttgcttagaaagaataattttcccaatattttatatataacattagtcatacaaataccaaggttaaaaacaatggctcatctagccttatttattattaactttcttttcttctttacttttcattctttctgacttctttctagttctgttgttttctggatcagatagaaaggctttctaaaggtggtcttcagctgaggttgatgtgttttagaatttaggattctgtcagtaccattttacttattttgtatcactgtttcgccaacatggtttaaattattgtttgtatttatattggtcttaatacagactttgtctttctgaaaaatctagtaccctaaggttaggagacttagctataattacctatttggtaagcaataatgaatcagtattgcaaatgttgaaaatctagctacccaacaccaacgaaaaatagtacacagttatttacttactattttattgtaattaaagtttcaatagactgccaattagatgaatgtatacaatacagacaaaatatagtacaagctctcagaaaacctccacaaaataaaaaaataagcaaaattgttggctacttttaaaaatgtattctacttgtacatttaaaataaacgtttaatcttcgtatttattatggaatggccctatggaaaaaatggactaagaatattctgtttagtatttttacatattaaggagaaaaggtcattacaatcattaagtgattatatatgtatatcattgggctaaatttaaccagccaactaatgtacattaataataaggtcatcagccagaagaaaaataatgacatttttggttttaaactaattacagggaatcaaagaatagttactttgtgtgcaactctttatggtactcgtgggatgtcaaggatatgtacagcagattgcctactgtctaagaatgtggatttcctttgggagataatactaacccttacggagaattttaataaacagtatacagcagtgtttactatttcttcagtggatggtcctcagggatactagaaaaaagcctagagaatcattgagaaatactgtcaatagtggaaaattagccattagtaagaagataggataggagacagaattccagaattgataatgatgagaaggtatgatgataatatatggattaaagtcagaatgaatggatttttaataaaattagtttggggaacaaaaattgagtgcattttaatttttgctttttcttcataaagtaacataattttatggagattctaggccctcagtagccaagcattcaggttagatatactcagtacatgaattattctattatgtggctgtgcctcattaaatactcatttacacaagtcagtgaggttttcccccatcactaattatgttttggttttccattatttattcattacttttttatcttccatgatacatcaaaaaagaaaccaaaacaaacagaacttttagattattattccattatctcaattcttttgctggtactacacaccatcaccatctcatatcattgtggttttctccatgtgctaattattgctgttttatctttgtgtttctgtgttatatctttttaaatccttttgaggtctctttctattctcctctacattagccgtgactcttaattaccacagggtcatatttagcaaatattctaatttacttgtcttctaagattcatatgctccctaaggacatttatgtcacaacacagataattaagcaatttataagtcctagaggtgtctaaattcgatgtcgggcaggggttaggggagtggaaggtggcatcagtttgcaaccagttacccaaaactgagaacaaaaataggaattaccataattccagatgatttcaaaggagcttgtttaatcattctctcctaacttcaaaatggcattatttaatacacttatgtttttaatactaacgttaggctaaaaccgggatttaatttctcttccaggaaactctgttgaaaaatatattttattgaaacatattgctggtttttctgtgagcaattatcaatatcttaattataataataattaattggatcagatcagtataaaaagctttgaaatgaaagcatgacaagtcatttgagaaaataaatatactattgatgaaaatgtcataacagaatggcctgttctatagtaagacatattatgctaaaatatgactacaaatttatttttaaaattaagataatttgacatcttaatttatcttatgatatcttgtttgacatcttatcacttttcagcttaaacacattttaaatatgattggtgtgtacttttggttatgtaatcatggttagcagactctatgattaaaataaatattgggcatggttgccaaaataaaaaatacttttttaaaaatgaaataattgtgttaaggcattcttttggattgaaggtaggtggatttctaatgaaaggaggaaattaaagggcatacaacttttgaattagaggatgggaagtaagtggtttagcctcaaaaatgctctttataatttctaagtgtttggaaatgttatctcttaaagccagaactatttcaaacaaaagctcagtcacaatgtcataatgaggaaactgtttcctaagtattagctgtactctttctgctgtcaataatctgaatatcaccagtgaccacggctgaaaataccggcagctataaattgttttatcaaatcactttttgaaattataagggggttgtaaacataagtccaagccccatgtgcttaagtatagttaagattttaaaaatatgtatcttttttgttttttaagacacaagctcttgctctcttgcccaggctgggatgcagtggtgcaatcatagctcactgcagtctttaaactcctgggctcaagtgaaccttctgcctcagcctcctgagtagctaggaccacaggtgtgtgccaccaggctcggctaattttttaaaacagtttttttttttttagaaatggagtctcactatgttgcccaggttcatcttgaactatatcctcaagtgatcctcctctggtggcctcacaaagcactaggtttataagagtgagtcacagagcttggccccctagaatatatatcttatgcattaatatgaaaaggaataattgagagataagactctaatctgaaatctctgaaactctgtaagcctatttaaatacattctactaaaaaagtagccataacacaggaaggaaattcatatatggcagcagaatgattccaagcaaaatgttagttacgtattcattggtctaagtgtttatttatatataggcaattacaaaatagtaggtttgggaagaaccaaggaagattcattgatttataatgcctagagacagcatcagctggcttcgatgtcatcctagtgtttttcatttggtttctttgttgttttatttgttgtgctgttgggtatatggaggtgatagatccaactctgtaccgctgtgaaatcaagaaacttactattcagtttgtgtttgagtaaataggtgccctattgaaacaacaacaaaaacaaacacagtagcacagataaagaattactgaacaaaggcaccgacaattgtacctcataaaatttgagatgaggaaagattatcagaaaattcgattggccacgtagcctcacataatggccaatagtaatggatgatttgttaattatttgtaagatttggtctactcagtatctgttggaatcccagtagtgatagacatcagtagtgtaactaacactgattaatcagtgaagctgtgcatatcaatgttgtgttttgacagtattgtttctttctttctctagagcagtgtttctccactgggggtgattttgctcccaggagacatttgtcagctctggagacatttttgattgtcctgaatgaatgtgaggggtttgctgtgggaatctagtgagtagaggtcagaaatgtgcatcctacacttaacgcaaccagaaatgtcaggagtgtagagtttgagaaaccctgttctagacagagatacaagagaaaccctgtgataattagaaggtaattttctgaggtgggatcaaagtaatgacttttaaattgataattttaagggagatattaaactgtggcttccaggttcattagtttcaggtacttttcttcttttgaataaccctgcaaagaagaccagcatgcatgagtaggatcatttggccttggcttcctctcttgtgtgtattgctgagtataaaataaaagtgtgacccagttttcttacaatttttggatgatacttctgattgggacttttttgttcagataagttagtatcacttatttggctattgccaactttttttttttttttttttactaggaagcagttgttcctttttaagatagaggataaaaactgatggctactggggactccagtcagcataattgctttcattggtgcattgtgcttatgaataattgaatttcatcatcttttgcttgggcatgtccttcccctcgctatagcagttaccatttcctgttgctagataccttcatatttatcttatttttatcattcactatgaaaatatttagatacttattatatccacaatatttatttaaaaatgattatttatgtttgtttacattatttaggtaatatttggaatatttccaattcagtcatcaaaataggatgtaacattgatgtacattcagggaaacaaatggaataatacatgtttcagcaaagattggacacctttctatatttagttagggaaggaaacattgaatctaccatagacatttaggctcttcaaaattttctgtaagttagatatatgtgaaagtgaattccagcatagctttaaaagtagtggtcattaaaacagggaaattagaaagaaaatttctgatccttaccctggaagtctactcaggcactattttaattaaaagtgtgagaggaaatagtcttgttgcttctatgtgtttgcaagtgtgacaggattaccctgcagtttcaaacagttattcatacagttccccataggtttaaagggctaaaattgactactacattattattttttaccctcaattaccattatgaaggatctagaaattagattctactaactaatttattcatgaggacaaagtatctcagatggtaggaccattttattgtcaataatcatagtgttactaataaatccacattcatagccatttattatgcatattgttaaatgagtaagtcatccttataaacaaagttatctaagtaatatataaataaaattatctgagtaatataaaaataatattaaaaataatataactaaattgtttccttcagataggaatacaattatgacaaaaattaattagatgacacttgtttaattatatgaactagagcttggttcaatcttgtctgacagagcctattagatatatgtgataaaaggattacaattccagtgttgatttttttagaagattcttatttagtctctttggagctggaggtgtcagacaggatgctggaaaccaacaggcagctagatttataacaactgtttgcgattgttttggaatttggcttcctgagaggtcagctctctgacgtgtatccagaatcagtcagtccatcttgagcaagtcgaggctctagtttaaacatttgatggatatttctgcccttcattttcttgctgaataattttatatattgctgtctcccagtcatagaaagccaattagaaatttttaaaaatactggccaaaggatacaaagtgtcagacagaaggaataataagctttagagaaacacaacagggcaaccagagttaagaataatgtattgtgtatttcaaaattactgagagtaaatttcaaatgtcttactacaaaaagatgggtatgggagctgatgaatatgttaattagcttgctttaatcattccacattgtgtattcttccatatatatcagaacatcacattttaccccataaatatatacaattatagtttataaactaaaattattaatacaaataaaataataaaacactcagtgttttattactttatgatggaacttaagcaaacaaaatacattttcgagaaacttttcaagctttggaagttgatgatataaaaataatttttcccttcttttgatctttcagaatacttcagtctacacagctttgatgatgtagaactatgcgttgccaaaacttctgcagcccttccacacttcacattacataatacagatattttaatagtatattggaaatatattaaattagtattttagtttgcttgtgaaacatgcgtgagcattcaaggaagttcaatttttggtaaacattaaatgataatgacagctcattatagagctagaaagcattttccctgtctcctacttcagttgaaatttaaaaaagtaaaaaatcaactgagacccagagaaataaagagacttgctcaataaatctagtgtagtcttgagactaaggaaaacatttcttgactcctaatccattgttgtttttaatattactagctgagaattccattcaaaataccttttaaagaaatgtgaaaataaataatgatcctttagttttttatatatataaaaatctatgtttatttgtggaatttttacttaaaccttttaggaaagatgcttgaattaaatatatgtatgtttgtatgtatttattcatatgttcacataatacagatagaatagatatctatgtatagatctatctatgcagatattgatctatctatatctatcaatcaatcaaccagtctatccattttactaccagataatcagtaaggaaacattatatagtgagtggaaaagaggaaaactgtgagtgtggtttacatagctttgtttgccttaacttgtctgaagtcatcatatttgtttttaacatattttaaatattgtgatgactataacctgtgtcatcattctttccatccaaatgttttcaattattgttgaaatattgcctcgtgaacaaaggataacaaccttggctgcattacacacacacgcacgcgcacacacacacacacacacacagacacacacaccccaccaagcaagcagcacctattattatgaactactactctacttctcttctttcccctgatatatctggctgaaataatctagtttatatttgaatttcttctgtgtcttaaaaacttgtagagatttttctacttctccatctttatgatgtttctgcatcattgttgaaatgactcattatgccttattactttattaatttatttgccaagtgttgtttggatccctgttgtgtgtcagataatattccagattctggggatacaatggagagcaagacaagtttgtcagactgacaataaatgagtaattcattgaaaatacaagaaaatgtcagctagtaaatttaaatccttgttgaaaaataacatagggtgaggtctagagaatgattagttgcttaggaaaggctcactacggagataacatttcaaggtcaaattgaagagttgtgtaggttgcaaggccagtaattacaaacaacatagggttcaaactatatagatctattccaagaacagaaaatatgtaagtggtggacatgggtagagaatggtacaagatgaactcaatgagataactaggggaaagatttatactgagttttgtaggtcaaggttttattttgtgagcagtaggtacactctgaagaaagaaagtggcaatacctaagtcatattttaaaagtacactctgtcaattatatggagagcattttctagggatattaaagtagaaactgagagaccattctgaaggctattgcagtggtacaagtaggagaagatgcagggtgtgaactatgtacagggatgctattggagaaggtaaaaagtaggtgggtggaggatttgcttggagataaaatgggtagggctttgttggttaattaccttcaacttgttggaaatagaggaatcagcatcatctctgaggttttaaatgtcattaaatgggtaattctattttgaatattttgccacaatttttgacaatggaatctatttcatggttaggtcttatatgtacatgtttatgcatgttttctgtgtataacagtataacagaggaatttttagaagcctggttgaaaaaatcttgaaataaaattaacaaatttataataaatagaacatagacatgcaatccattgtctcttggggcttaaaatatattatattgcctatgattatttgattcaatgactccataatattttatatgctttttctgtcccaactacaactacagctgaagatacaatagaaaataggagagaaaataggagagctcctgccataaggaaaacaggagagctcctgccgtaaggatctcattatgtattaagggagatatgcactaatcaaataattagatatataaacatttacaatttatgacatagaataactgcaaagtataggaatataagaatgaaagttaaatattgcttttacttttattgcttaatatccatgtcagaatttctaatgcattggctgtatctgttttaaataagtcacggaaagctttcctaaagaaatgaagatgagccgggctcaatggctcacgcctgtaatcccagcactttgggagcctgaggcaggtggatcacaaggtcaagagattaagaccatcctggccaacatggcgaaaccccatctctactaaaaatacaaaaattagctgagtgtggtggcatgtgcttctagtcccagctactcaggaggctgaggcaggagaattgcttgaacttgggaggcggaggttgcagtgagctgagatagcgccactgcactacagcctggcaacagagcgagacttcatctctaagtaaataaataaataagaaatgaagatgactgcagataagttgactaagcaagaatatggcttgagcatagtgggacaggcatgaggcatggagtattagaaacaaagaatgccatggtagtgggagcagcacaaggaagggggaaacaggttggagaattaagtagtggccagatcatgcgggtcatggtgctaaattttcaaaaatgatcagatttgcttttggaaacaaatatattcccgttgaagtgagaaagtaagttaaaattgaaagttgtggctcaagaaaggacaaataaagacactagtggatggcctaggcttgagattataagcaaatggacttaggcagtgccagcagagaagagaaagatttggacgataataataagtaaaataaaaagaaagtaacaaaataagaatgtagtggttggtgatggcggttagaatgatgtatcagggataattcttgagattttggttgtatgacttaaatgaaaggggagttaaccattgagatggggaattctgggtgagaaccaggtttgagcgtatggttggatgaaaatatctgttaaacggcatttagtaactaagtggggaaatctatcaaacagtatttagggtgtcacatttcttgattcaaatgtgaaaaatgaacctttaagttaaaaatagtctccactcctaggtggaggttacagtgagctgagattgcgccactgcactccagcctggacgacagagcaagactctgtctcaaaaacaaaataaaacaaaagaacacaaaacaaaacaaaacaaaacaaaggtagtctccacttcttaaaaagaaggagcagagttgtggatcatatggtaattctgtattagcagtttgaggaacttctaaggtggttgcatggatttgccttcctagcaatggtataagaggggcttgattaattcacatctctacaaaacaggttcttacctatttgattttagccattttagtgggtgtgaagtaatatcttgccatggcatttatttgtattcccttaatttattgatgatattgaggatcttttcttgtgcttattgatcatttgtatatctttgttggagaaatgtctgttcaaattctttgcccattttttattgagctcttttcaattgctgaattgtaagattttttcatatattataaatcaaattccttgtcagatacataagtttcaaatgttttctcccaggtatgttgtctttcactttctgattggtgtcttttgatgcaccagatttaaatgttgataaagtcaaatctattttttctttagttttctatacattgttaatttagactaacttctttttgtgtgtttgagaacataatagatttttatttctatgtttagttctatgatacattttgagtggattttttaatatgatgtgaggaaagaggtccacatttattcttttgcatgtggaaatacaattatccatgtaacatttttgaaaagatttttttttctgttgaataattttggcacccttctcaaatgtcagctgaccacaaatatatgattttgtcttgggactctgtattctattaatctatatgtttatccttaggccagaagttcagtcttgactgttgtagctatgtggtgagacttgtaatcaagatgtgtgagcccttgaactttgctctttttcaaaattggatttctgtgtcccttacatttccatatgaattttaagatcaactcgtaaaatttgcaaacaaagtcaaaagaagctaagacttttgatggtgattatattgcttatgtagatcaatttgaaaaatagtgctacactaacaaggttctgatctgtagacatacaatgtcttttaatttatttagatattattcagtttcttaaaagaatgtgttatatttttccatctaaaaatcatacttttattgttgaatttgttactaggtattttattgcttttgtggccattataaatagaattgtttactccatttcatctttaaattgtttgcagctagtgtatagaaatgtaatgatttttgtgtgttgaatgcttatcctgccacattgctgtatttgtttagtagtccaggctctttatactcataaggggttatcagtctgtagctttttccaactatgtctttgtctggttttgatatcaagataatactagcctaatagaataagtagcaaattgtttcttccttttattttttggaaaagtttatgaaggattttttttaatgtttcatggaactcactgatgataccattatggcctaggcttctttttcacaggaagttttaaatttatttcatcaatccttttacatgttataagcctattccaaatatatattacttctgaaatttatgtctttctaagacttcttgttttgatctaaataactgaatttgttgataagcaattttatagtattctgttacatgttcatttctgtaaggttgatactgatgcctcttctttcatgcctgattttagtaatttgaatcttgttattttttctcatccatctatctagaggcttgccaattttatttttcttttcaaggaagaaactctcagccttattcattttctccattgtttttttagcctagatgtaacttatttccacctaagcttttttatttccttccttctgcttgcttgtgttagtttccttgtttttttcctgacttctttaggtagaagtttaagctattaatttgagatatgtattttcttcttgcccttttttcttctttcttcttcttcttcttcttcttcttcttcttttttttttttttgacacagggtctcactctgttacctagtctggagtgtagtggtacaatcatatctcactgcagcctcaacctcccaggctcaagtgatcctcccacctcagcctcctgagtatctgcactacagatgtgtgccaccattcccagctaatttttttaaaaaaagttttgtcacactgtggtctcactatgtttcctaggctgatcttgaccttctgggctcaagtgatcctcctgtcttggtctgccaaagtgttgggattacaggtgtgagccaccacacaagacttcctccctcccttccccactccctcccctctttccttccttcctgtctccctccctttcttttcttctcttctatttttctttctttttgacaaagtctcactctgttgcccaggctggagtgcagtgttgtgatcatggctcactgtagccccaatctcccaggcttaagcaaccttcccacctgagcctcctgagaagctgggacttcaggcatgagccaccatgtctagctaaatttttaattttttgttagattgtgtcatactattttgcccaggctggttgtgaacaacttaccccaagcaatcctcccacctaggcctcccaaagggaggattacagacatgagccaccgcacatggcctaagattacagatatgagccactgcacctggcctctggctttttctttctttcttcctttcttttcttttcttctttctttttttcctctttactttctcactctatttcgttcctaatatagatttttacagctaataatttccctgtaagttcttctttactatatatcataaatttttgtattttgtgttttcattttcattcttctcaaagcattttattatttctgttgttatttatttcttgattcattggttatttaggtaactgttgtttagtatctatatatttgtgaatttcccaaattgccttccattattgatttttaatataatttcatttgggtcaaataacatactttttataatttcaatacttttccattcattgaaacatgttttgtggcctaacatatgatctcacctagaaaatatttcatgcaaacctcataagtatgtgtgtattttctgctagcatttctgtctgtaagatctttttgctttagaatgttgtttgtcttctattttattactgatgttctgcctactggttctatccattgctgaaatcaaggttttgaagtctccaactatttattattaaattgtttattttccctttcaattctataaatttttgcttcatatatttgtgagctctattattatgtgcatacatatttataattgttttatttttctgatagaatggcccttttattattgcataatttttatctttgtctctagtaagaatttttgccttagagtgtatttcatttgatgttagtgaaaccattctatccttgttttgtttaccagtttcatggtatacctttttcacctttttattttaaacttattagtgtcttcaatttagaatatatcctttgtatacagcatataattattttaaaaaaatttatcctgtcaacctacacattttgattcatgtgtttattttcatttaatgcaattattaataaggtagaacatatattggccatttatttaataatatttgttttctacatatcatatgtcatttttgtttctccattcttggatttctcactccttttttgttagatattttctgctgtatcttttatatttgctattgttcctttttactattttttgtgttatttatttagccattgccttgtaatttacaactagcatcttaatttagaaaaaatttgttcagataaaatactaatttaatttcaatggcatacaaacattattccaacttcatttcatgtttttcacccctttgtactgtaattttcatacaagttatatctttatatgttataacccaatcaacacgcttttataataattgtttttatgcagctatgttctaaaacaagtaggataagaaaggagttacaagcaaatgtgtttatgttttctttcataataactgtgtggatacttttactaggtcattttgtgtcttcatgtggtttcaagtgactatttattgtcatttcatttcagcctgaaggacttcttcctttagtgtttccttagagcggggctaaaagtaacaaatgctctcaggttttgtttatttagaaatgacaacttctccttcctttatgagagaaagtttagctcgatatagaattctttgttgacaagctttttcttttaatactttgaagacgtcaacctaaatctcttctgacctctgtggtttcttatgaaaagtcagctgttattataattgagggttccttgtatgtgatgttatgtttttagtgctgttttcattaatttctctttgtctaagttttgtcaacttgactatgatctatctatgtgtggatctttttgagcagaatttttttgagtagaaacttggaattttttgaacttcttaagtatatatattatgttttatcaaatcgagaaggttggagtcattattttttaaaacttgtttctacatatttctccttttcttctctatagtctttatggttttccttctttttaaatattggatatgtctcactctatacattatttatatgtgtctcttaaaatagtaactttaaattataattttaataaaacatggtctaataatctaaatattactctcagggttttccagtgacattttttaaaacaagataatgaaaacatatattgtaaaatataaatatttacactatctgatatgaagttcattagatacatgtggctacttaatttttaattaattaaaatcatgtaaaatttaaaattccatctttcagtcacactatccacattacaagttttcaatagctaaatgaaaccaacagctactacattgtacatcgtagagataaaacattttcatcatcacagaaatttctgttagatagaactgttgcagatgtatatatcataaaaaattcccccttcataactcagtacccatttttgaatgaagccatgtaaatatttgtatctgtcaaaaatcttctacagaaatatgtttgtatatatcttcatggatctatacataaacaatataatattctataatatatacatttatatgtgtgtgtatgtgtatatgtaagtgtatacgtctacattatatttaatttcaacagtacatatggtctatactttttatccacttaatgtatcttgaagagctttttatatgaacttttttaaaacaaaaaaaattgtgtaatagcaccataaagtgttcttgtatgatgtattaccactggtttaaatatttttctattacattactgctccaaaacaaacataaacaaacagcaaagcaggcatatttcaaatatatatgtaggctaaatatattccagtgtattggtgagtcaaagaaagtttatattgcaatttattagataatatcaaatttcattaatcaaacccaccaatagtgtatgatactctctgttagtccactcttcctgttgttgggtattgttcaaccttttagttattttcaatttggctgataaaagatagaatttaatccttatgttgatttacaatgatttaattatgagagaggttgagaatcatctttttatatgtgcattggccattgttgttttctggtgtttgaattcctgtgcataagtctttcatattgggactttgcaaatgacactcatggcaggaacattttaaaaaaatatttgtacttagtcttaatctaactggaattattcattcattaatatctgtaaagtccactgaaaggatgttctgtgtttcacatatcttaataaacctttatctgttgaaactggcctgaaagaagaaatgaatgaatgtaaaggaagagagaacaatgggaacagttgtgagtaaatgtctataattaactcattcagttataaacacctgtttaataaaattggaggaatcatctaccctataagagttggaaatattacccttaaattttccttcagtttttaaaatgaaataaaatgaataatgaaaaaataaacacacacactgaacaccttcttccagccttaggattaattcagcctctatttggacattgaaaaacatgcataaaactgatttatcttagcattctacacacttcacaaaaaaattgaagctattggtgaacatttctgagaaagtggacaatacaagaaaaggcttttggatttgggccataaaaatgcaagtttagtgcatgacaactcaactagtgaatgtctgcctcagctcctaagcacagttgaggagatcagcagtgtttgcagatgttcttgggagacagtaaaatagaacccggttcttacttcagagcttgagattttgctcaagacattgaatctggaggcagctcttgattgtttcttattgtcattgtcactaaattggacttgattttataggccttctttctttccccaactaagcagaaagtgccaccagggatgtaaatctaaaattattcttttcctttatttttgttatttgctttggcatggaagggtcatttatgatatctctgcttatcaaaaggatactgacaaataaacaggaaacagcaaatcaatctattattaggagtcccgaacaggaggtataatgttacatcggttaatatattcaagaaatattgatattctaagctgaaaacctgagccttgttattctttgttttttttttttttttccaagtgaattgcacattcagaatcttcttaatggtcagatccttatattttttgttgcttgcatcctgtatctgttataatttcatgttaaaattagaggatggagatattttagcataccaatatgctaagttgtaaattatgaagacataatgaaaactcttagttaacttagagaatgttaatgtaattaatatgtaaaaactcttccaaatcaattgaaaatgaacaaaaaatataaatggactttttatcaaaaaatattgttgataaatttaaaagctgcttaacataattcacaaacaggaatatttatcaacaagaagatagtatttttcacatatcctattggcaaagattaaccctgatgttaccatgtattggaaagactgtggaataatagagcctcttactccttgatagcaggaatgtcatttgtgtttttactttgggtaaaattttgtcattattgtgtgaagtataactttcacatgccctgtaatctaaaaattccttcctaggtatataccataaggaagcaattgcacgtgtatttcaggaaacaggaacagggaggtttattcagtcatagttgcaaacaaccactggtctcctcaactgtgcttaggagctattaatggatatttctgataaaatgacctgtagaatgcatggctttcaaccttggagaattaaagtgcaagtttagtaaatgaaaacccaacttttaaattaattcactatgtaaattatttatatccttgggtttctggttaatgtctaactcagtttgctttgatacatatatatatgtttgcctatatgatgtataatttaatcttagttggtcttgaacttttgaaagaggcatcaggtagtccatgatcatcttatacttccctttatcactcagcattttgttactgattcatgcatatttgcatttaacctgtagtccagttattttataactacaagatattctatttatgtcattctcttggttatatgatatgccattctttacatatattaccatatatttattgtttatcttacatttaaatttaattgggaattaaatttgtaattgctaaatctatcacgattgacaatacgtgaagagacaaaagctgcaattaatccaattcaagagagaaaatgataaggatagagtagatatctgtcttatctattaattcatatttgtcttatctgctaaatagatatctgtcttatctactagttcattttgtattgctgtaaaggaatatctgaggctgggtaatttacgtaaaagatgtttatttggctagtgattctgtagactgtgcgaaaagcatggccctggcatctgcttctggtgagggcttcaagttgctttattcatagtggaaggtaaagggcagcctgcatgtgcagagataacatggtgagaaaggaagcaagaaaaagagagaggacgtgccaggctctttttaacaaccagctctcatgagaactaatagagtaagaactcagtatgataaaaatggcaccaagccattcatgaggaagcctgtcccatgacctaaacacctatcattagagccccacctccaacactggggatcaaatttcgatatgaggtttgaaggagtcaaacatcgaaactgtagcaatatcaaatatggtatcactgaggaatatatatgaatatatcaaatctggcacaattaaatatcttttttatttgttaacctatgttttctcctattttttggaattattaattataatgctaaattaatgatgttatataaacctaaaatgagcctttgaaccatcagctgtcaagaagatttagtctttgaagcactactatttttctgtttctatttcataaaaagaaaattcagccatggtaaaaaaagtttttttacttaatattggacattatagtttcccttctttttgtaaatatgggaattgcaaagcttttggtaaccattatttttcttacactagaaataaaatcatattactaattgaaatacttaaaatatgcgtgttttaaaataataattatattatttttgtttatgaaattatactctgtaaaatgtgcctgatgggctatcagaacaagaatgaaattaagtaactttctactgggcagctccggtctactcatcttgtaagtattatgttacacacattgtataaggccatggtgaggaaaactcataccgaaattctaatgtcaaattttttaggacttccatagcttttatatgctgtattctttaatgcagctgtgcttgaaggtcacagcaccatttaaaaatatatatatacttgatataggatgattataaagcactaagacaatttgaagaatcattagaccagcacaaactgaacttcacataaataatttgcataaatatggaagttacaatatttcttttcttctttcatcagcccataacttttccaatttattaaagtgttgggtagagaaatattggcatgactctcaaattcaccttttctgccctatttttttaagttattaatagatttcagtgatcattaatttccactttctgcgaaaaataaaaattgctttttaaatgttttagtgtatggcctatgatgtaaatgaatagaatattattttggctgtttacatttattgagcaataaaaatatatgtgtgtcagtctatatggattagtaggtattgattcaatactcataaaaattacgtagttgtatcatggcattttctgcattgggttgttttattaaatactccaatatcaaaatgcatggtaacaagaaaatatatatatagagagagcatctattatgtttacaaaatatagatattgcagatgtcaggaaagagatataatttaagcatgatcataattaattagtcagctaagaaaagagaacatgaaaaaatacacagtaaaaaaaattgattttaaaattttctgcatatatagccagctatagctacagagaacaatcaagcctttgtttacagctaaattataaaagctatttgcttcttttctgttcttaaatccagacagtgaaagagagtgtgtcttttgcatcattctagggactgctgcctcctttcccagcttctcttgatttcccttttcttcttttcaactagatcgtaatctttttccctcttctcctccacttatggtccactggctttctaaaatccttcctcatgctcaaaccagggaatttggtcatttatggactgcactatgaaagaagcattttcataatatatacttaattacatgtttcaaaattaacatctttccaaaatgatagatggcttttctaaatatttttgtcaggtatcaaaaaactaataatgagattgagtagtgagggaagttataccctaaataaattaaacataaaggatggccgggcgtcatggctcacgcctgcaatcccagcactttgggaggccaaggcaggtggatcatgaggtcaggagtttgagaccagtctggccaacatagtgaaaccccgtctctactaaaaatacaaaaaattagccgggcgtggtggcgggcacctgtagtcccagctactcgggaggctgaggcaggagaactgcatgaacctgggaggcacaggttgcagtgagccaagatagcgccattgcactccagcccgggtgacagtgcgagactccatcaaaaaacaaaacaaaacaaaacataaaggatatgtgtgtgaatatttagggagtttgatgggctggaggttgagggagcagggaaaatatcataggatccaagaagacttacatttttgtctccatcattcactatctgttaaaaatgtacccatctatactttcagaattattcagccaaagctcctggagcatgatttttttttttaattttgtaaatagagatgtctttagatatttttattaccagcttattccaaggtctagaacaatacacatccctactacacagttcctaaggttctgccgtttctcaatgttaaggcaaccaagtcctttataccaacttgtattaattgtaactgcatctctcattctgccttcactcagtcttttctcagtctcaagtcatgcaaatgaatattttatgttttctgacacttctgacatttaagtttgtgtttaatgatttcttgctatgatctttaatatctgacatcttggaataccatcattatctcattttctacctctagttataatgtttctgacaaaagtgaatcattgtaatggggcctcttaatagggacattaccgtggcaataaaagatgtaaattgcagttccaaacaacctagaagtgcaatcacgaaacagtgatcaatggttagatgaactgcacgtgtaattaaatacatgtgaggtcagatgaatcacttgagctaagaaggacagggaaggcttaaaggagaagaattagaatgatccttcagagaaacacaatttgagtaaggaaaagggaaaggtgaaggtggtatagcaagtagagaaagttgaacaaaggtacaagaaaaagaaaacatgcacatttaaagaatacaagcaatggtacaccatgttcataactgcatgattactggcccacccggtagagcatgtcatttggggaacttgttccttttctttagagggcatggatttacgtggaacataaactttcatctattactctgtataaatgataaaagatgaggctttctggcatctctcttaaactccaggctttttatccacaaatcctgcacatttcctattggctatccttcaggagcgataacaataatgtatataaaattcgaatgtctaaaactttcctcaaaatatgcctgtttttctttattttctccagtgagaatgttacaaaagcaacattcacccaatgataaaaacttgaaaacctggagttattctgtatactttcttctttctccatcttcaaatctaatccttatttttttttttttgtattttattcacaatctcccctgtacatgtccctttcactctttgcctctgcttcttccttaactttgtaacattgctttcttggattgtcatgagcctcttaccatctctcatgaactcgagatgtcatcaaatctaactagtttttcacccagttgccaaggtaatagttctaaattcaaacctgattttgcttctttcttggctttcagttttaccacttatgaaaacagtaataagcactggcatattcatgttgacaataatgcatacttcatacataatagcagtaatctatggaatcatccctcatcttcccaagaattgtttttaagctacttgtgcattttttgaagtttattctcatattgtaggttgtaattcaaaactggcaagcttgtaggctccagacagaatctggcccccaagtatatttaggattgaatcataattttaaaattatgaaattataagttaaattttgctttctaacttttttgaaaaaaatggaaaactagcaatactgtgtatttttctataggacattgtatctggagctgaggagctactgtgctcttttaaataggcggtctgattactccgcctctctgtgattcttacacagacagcttcagtcttaccctgcttacccagtggtttcaagcaaccatgttttggacccttgctctaccagtgactaacgaggttcatgacatgcatcttatcctgaacaatatggaaagggaaacatcctagtgggtttggtttcccaactttgtagcaccttcagtgtctgcctgggggcttgttgtacagtgaatgttcaacacataagattcgcttgaatggaatgatacgtacaaaacaggcaccaccaaatgttcccaagctgccggaaaacatacatttgtttctctacttgatcacataccttgtctttcttgcttaattcatctagttaatcacctgcatatttgctttactctgtttatcatatcttgcttgccttcaacagaatgtacatagatggcaggattcatgcatttttatgccctttgtactattttggatgtcgaaaactggacaggcaggcatcattgctgagtaatggcaatgaacacatgtggaaattacttttgcatcctttcatttcaatagtaattaagttgttaaatatgaaggtactgtaatagcattattggcaataatcaacttccccaaaccacaatttgaagtcatattaagttgaaattaaaccagaactatttaatgtctacaattagaatcagtgttgaccaagatgtctcctgtggctgaaagaaagaataccccaaatgcaataaataataacattaaaggcatacactaagagggattgacctaagatttccaacatcttctggcgtgttgactaagctgccgagatacgtttcttattcgtgtatcatcagtaagtttctctgcagcatcagtgacctgcccacgactctttaatttcagagaagattcagcagcttgggccccggaaaagatatttggaaaatttcccagtttgtgtgctgcataagcttgaggcagtagagggataattaataaagtgccagactgggtaattgtaggaactgtaaaagatactaagacgttgttaccggaggcacagacgcacctgtgaaagcgtgaagttaatttgtgtgaggaacatcacatgagggtggatgaggatgagggaggtgagatttccttcaaattaattcagactttagtcagagaagctctcaaaaaaaaaaaaaaaaaaaaaaaaaaccctcctgctagtgagataatgtaaggcttatgaaaagaggccctcctggattgtcttgttacgtatgcttctctctgaccttgagaaaggtgtaacaactgcaacgttggaattttctaatccctgtaggacaagaatgatgacattgccctatcagtctttacataacagcgtaccatttcatactgtccccttgaacatttccttaaaaacaatacacctcctgatactataatgttggatactttgtgtatccagtgtcaccccaaattccccataggttaatttctatcaaatttcaatatacaataaagtaatgagagagagaattaggtcgtatcatagtattgccctgaagactgtttaaaatcattgataactgcaaagttcctaacaacttgcagaccacatggtagatgactgatcagtggtagctgctaatgttgttattttcatggttatttaaatggatcttttaaaaactaaaaaacaaaattcttgacatgaattgttgccagtgaatgttgttatcttcttctaaaatgccttatatgtagattgtacaagataggtgtaaacccccataccttagcattgccatatggtgatgtctcgctgaccattccattctcttgcatatctggctcaggaattaataacctatgtcattccaaaaatgattctctgataccaattgagtgctctacaattcaattcaatacggagactaattaccaggaattagcgtacacccacagttaaggagctcaattcccctggtctgtcctcacctcagatgccagctgccagtccctggtcccaatggtactgaattatgtccaacctggctacaaatgtgagggttctcattaccccttttcaggctggagaatttcttagaatgactcaaagagctcggacaagagctattcttatgagtagcagtttattgtagagggtacaaatgaacagctagatgaagagatatatggggtgatgtctgaaggggtccccagcacaggaggctctttctctttggactggggtacatcaccctcccaatgcatccatatgtttaccaaccagatggttccctcaacccttatcattcagagtttctaagcaaggtttcatcacttaggcatgatttattcaatcactggccagttgctgaactctgatctccagctcttctctcctaccagatcttagagtggggctgaaatttctaaacttgtaatcgcatgattgatgtgatctgatgaccagcttaatcctgaaactataagctaacgcctcccctcacaaagagtcctctgatgttgcagtcgcattagcatgaaatcgaataaagtgcaaagaagtttgctatgaataacaaaagacatttctatcatttaggaaatttcaagggtttttggagctctgtgccaagaaccagagaaaagaccaaatatatattttattataccacccaaacttgccaaatattgattagtctgaatttcttatcctatccattgtgttttggggtccctatgtaaaacaaacaaacaaacaaacaaaaacaaaacaaagaaactctgactttacacttttctggactttatagagagcagtcttatggaaactataaggtgtgcacaattgtttatgcacgtatttctctgcaaataccatgcaaagtatctattatgcttaaaattttatactatttattttgtgtttttttgtttctattttggagttttttcacacatcaactcaatgtgcttgccctctctttagacgtgaattagacaaatatctctatttcaagtgaaatcttttttctaccttgaatgtatttgtttcattgtgtagtttaaattccttctgtcctcaaatttgttcaattattagattataggctcaaaattagtcaagtacagtgtagtagtttttgtttgacatcaaatgcaatgttctgtatttgtgttttaatctgtttcaccctggggatttcctttaaagagagtctgtctttaatgttagtatctttttaaatataaacattcaaccagtaagaatacaaaaacacagagacagaaaattatgacaaacagaatgtcaatacttcttttccttttgattaatctagcatgcaaattataaaagcattttggttactcaggaatttcaataggcctttgaactttttaaataataaaaatattaacatattctttaagagataacatatagaaagatatattagcaaacctgttcttactgaaatgtctaatatgtcctctttaagctttttatattcatctgaataatcatacatacatacatgcaaatatgtatacaatataaaagaaatgagaatgccattttatagtgctatgaaaattgatttttttttacatttatacatccaaattcatgttaagaagtttttaaatataactggtttttttttctttttctaggtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaacattgattatggtcaagggattctttactggtatttgattgtcagcttggggttgtagaaaattttgcaaatggggcaagccaagcaattaattctgaacaaataaaatgttctaattgaaattagtgtttccttattccatgtgagccctaaagcacaattagagcaatatgtatggttgttgagtgttttgtacttaggtatcatttgcacgattaaaaagcaaagtaaatgttggaaagccaattcagcagattagtatctgtaaagaataaatgattggaaatcattcaaggacgtttatgagctttaagacgaacaataaaaatttatgaacttaaggcaggaagcctcatataatgctttgaaagccttttgaacacatggaatttcacagttcgaaagaactgctatttgatggctttagtcttttggaatatacatgtgctatatttttaaggttatattttttgacttaagtaatttatgctgtaaaagacagagggattttagtcaaaggcctcttttcctagtatagatgttggcctgttgtcttatcttttgctttgagttatctttattcattgggattttgtaagtcatatgttatagtaagaaaaatacttgacatttatagactaaaatattatgctaaaaagtttctaacataacattatctgaaaaatctaagcttgaaaagtctgctatattaaactgatcatgaacttttaaaaaatcaggtttcaggagctattgtaatgaagactggaactggcagtaggacaaacacatagatcaatgaaagagaagagagaacccagaaatagaccctcacaactatgcctaatagattgttggcaaaggtgcacaagcaatttaatggaggacagtcttttcaacaactagtgccagaacaatcagatatccataggcaaaaaataaaaacaaaaagcccacaaaaaacaaaaacatcatattggcttaagccacacaccttatacaaactcagaatggatcatgcttttaaatgtaaagtataaatctataaaacttttagaaaaaaatgtttgggatttaaggctagggaaaaatttcttaaactgtataccaaaagcacagtccaaaggaggataaactattgttccatgatagaccctgttttcaggctaaaaatacaagttacagtctagaagaaaatatttgaaattcccatgtgtgacaaaggatcaacattcatatataaagaattcttaaaaatgaacggttaaaaacaacaactataacaaaaacacaactatacaatcagaaagtgggcccagacatgaagagacatttcactgaagatttacagatggcaataagtacatgaaaatattttaacattactagccaataggtaaatgcaaattgaaactacaatagaatatcactacgaatctatcagaatggttaattttttttaagtgaccacacccaatgatggcaagcatgcagagaaactggatcattcatacattgcagttggaatgtataatggtacagctactttggaagatattttgatagttttttaaaaaactaagcatatatttgggttggttccaagtctttgctattgtgagttatgccacaataaacatatgtgtgcatgtgtctttatagcagcattatttgtattcctttgggtatatacccagtaatgggatggctgggtcaaatgatatttctagttctggatccctgaggaattgccacactgtcttccacaatggttgaactagtttacagtccaacaatgatagactggattaagaaaatgttgtggggtgggggagtggggagggatagcattaggagatatacctaatgcaaatgacgagttaatgggtacagcacaccaacatggcacatatatacatatgtaacaaacctgcacattgtgcacatgtaccctagaacttaaagtataataaaaataaataaataaataaataaataaaaaccaaaaaaaagaaatctaattataccacataaataaaccaacatttatttaaacattaaaaaaaaaactaagcatatactaccatccgacccagcaattaaatttcactggacaattccttcaagtcatttatcccggatacataaaagtattcacacaaaaacctgtatgcaaatatttgcagcagccttatttataatagccaaaaactgagacagcccagatgttcttcaaaggatgaatggctagataaactgtggtccattcatcccatgtaataaatattcagcaatacaaaggaacaagctttcaatgtagacagaaacatggataaatcttcggaattatgccaagtgaaaaaaaaacagtcccaaatatgattgtttgtatgatttcatctatataacattctcaaaatggcaaaattaaagaaatgaagaagagattagtagtttccaggagaaaaggagggaaatgagagcagctttttttgttttatgggacaacaagagggatctttgtggagatagaaatgctctgtatcttaattatataaatgtcaatgtccttgttgttttcttgacctggttgtttacttgaccaggatttcttatagttttataagatagtatcggtggggaaaactgggtgaagaacacctgtgatctctcagtattatttattataatggcatgtaaaaataattatgtcaaaataaaagattttaacttgaaaaagctgtaattttttaaaaagtcctaaaataaggcaaattttttttttttccggtgggagggaggccgagagtttcactcttgttgcccaggctgtagtacaatgcacgatctctgctcactgcaacctccacctcccaggttcaagtgattctcttgcctcagcctcctgagtagctgggattacaggcatgcaccaccacgcccagctagttttgtgtttttagtagagataaagtttcaccatgttggtcaggctggatttgaactcctgacctcaggggatccacccgcttcagccttgcaagtgtgagccaacatgcctggtggcaaaagtttttttttttttttttaattcagtttcaatttattttattaagtgtatggattatgcaagatcattgaaatcttttaccccgaacaaggtactggaaagaggtaaaaagatttaagtatgcatttccacatttatagttttatgcaaatctgatacagtttttaaagattagtgaatgaaaatagttaaaagtagtaaaaaatgatcaattattaaataaactagtgaaattagtttgagaacttttgtattcttgtccaagtcagttgatttctatctagaagaacaatttttactatttgttttcagggaagctggttaactgtctatgaaaagtaaaactgttttaggttatgccagatcatccctgatagtgtcacaataaccattctctaaacacagaaactgaaactgctttttcatcttatttttaaatagtaactttgtgtaatttaggtttatgtttttaaaatgtggaataaggaacataaaactaggttaactttgagtatttggacaaaatagggcacaaacttttaaaaatataattaacaatataaacataattatggaccagtcttcatattcttatggtcttttttttcttatcaaggaacaataaagatactttatgacaaaataactggaggtgaaagaatgctagcatttaaataaattttagaaactttatttcaccattttatatcatttcatttatttattcattttatttattaattatgtcccaggtgcaattgctgggctgtatattatagggtgtatttgtgggtatgctcacataaattgaattacctccttcaagaaatttataaccaggaagaggtgatatgacacaaacatttatatccacagcatacaacatcatgttatgtatcatatatatggtagtttcaaagaataaggaaaacttttactcagggtaatcatgttagagaagaatcatatgctgggctttgaagagcagacagctaaaaatgaatagaaaaacaggagtttgagaccagcctggccaacatggtgaaatgccatctccacaaaaaatacaaaaaatttagttgggtgtggtggcacacacctgcagtcccagctactttggaggctgaggaggagaatcacttgaacccaggaggcagagattttagtgagctgagattgactactgcactccagcctgagtgacagggcaagactctgtctcaaaaaaaaaaattaaataaagaaatagataaataaataaataaggcaagcagtcattctcactcttggctatggcattagaatcatctggagagttttacaaattgtttatgctgaggccctctcctgcagaaactctgatttaattggcctgaggtatagccccagctttggagttttacaaactccccaggagataatgtgcagctagggttgaagaccattgaatttaagtgaactgatctcttccacccattgaagactttccagatttcagaaaagggaaacattagaaataaaaataaaaacagctaattatttaaactgcatgtattttgtgccaaagtctttacttgtacacgcttaatccttatatcttttattcttaacacacaacagtagttggtgttattcttcctttattggtgaaaatacagagactaacttacctaatatgattcaagattgagtttttttttttttttcctgaaacagtgggtctcaatgtacatgctcagcatagcagcatcagcatagcctgggaagttattaaaaatccaaattctgttgtcccattgagacagaaactctaggagtgggcccagcaatctgtggtttgacaagcgtaagtgattctgatgcattcaagactgagaaccagtgtttagggacctgattccttaaactgcaagagcgctacctaagaagagagctacgcagccagaatctcaccatatgcaggacaaagattaatagaaaatatcatttaagagcaatgatctaccctgtttttctttagtttttcacaattatttcttcctggatttaacgtccaactgttcatttctgaccttggatgttgctctagtaacaaatttacccttcaaggttaatgtttgatctgttttcattataggtggcatagtggggtgtgcatggaagttggaagaaaatatgtgtttaaattcaaattatccatattaaaatttgtattgaaatataacatacctataggagcttgcatatactatgaagatagcttgaacttctataaaccaaacacctgtatggtgccatcacccagataaagcagcaaaacattgctgttctccattctgttactacgagccacaagggagaacactgtctacatttgtaaagattaattctgcctgtttttgcactttaggtaaattcacacactatgtactgttttgtgtatctcttattttactcaataattagttcataaaatatatccgtagttttcaagtattgtataacagattgtacattcccactatgatataccattccattgcacatatcacaattgatccactctactgttgattagattgtaatacagatgtacatgagcaatgcattattgtatagattatttgtctgatcactctctatttcccatccattactctgcttcttctttgacacctatttcaaaaaaatattatttaagagggcacaaacattttttgggtgcttagatagtgcatctgccgtggaagtgtgtttatcaatgtaaacctcccaaagtcccgcttcttggctgtttatatcatattttacagaggagacagacttagagatattaactaacttcctcaagggccccagttcacagttgcagagctgggagtgaattttttttcttagctccaaagtccctagcttttcgattactttgtcattttcagaaagttcttatttatctttacagattaactgtgtattttcctatttatttgaaatcatatcaactaattcctaattaattaattggaaggcaagtgaaacatactacaatatgtatttaataaacatattacaatatcaaacaatatatgattttcaatactcagtacttaatatacttctccagacatagtggttagacattttatttttgtatttgcatctttacaactgtttctcaaaatagtcaatgaaataatcattctggaatgccttttaatgccataaaattaaaaccatacttttaaagaagatgaaagcattccaaagtatggcaaatcatgatatgttaaaaccttgatgatcagaatatttgtggttaatatttgtcatctagtattttgatagtcaacatatcagactaaattattttttcagcattctgagtcatgtatataaatagttttaatttaaccaataaatctatgtaattttatatattatccatatatatttggaattattggtccattggaattatttaacaattgtatttttaagccatccttaaaaagtcaagagtcctttaccgcatttttttaaggacaaacatgaagtaaggagaaatcaatttttttaaaatttttaaacaaatttatagttttatagttttcttgtttggatttaaaatacaccatgtcaagtagactagttaactattttacactgtcaaccactttcttaatacatcttatgtttgttatcagaaactttaattaaatttactcttgtttcagcagaattagagctgtcctctatacataatgggacataaatctgcataagaattagctttttccgaatgcaagagtaacagttgaatgaatcctttaaatcgtgtctactagagggaacaaatcaaccgtagctgggctacatctgctatgttagtagtatctgtcctctaaattcgatgctctgcaaaagatcagcattgttattttctacagttagatgcattcatttcagtttaggtctctactattttatagctctgggtacagaattatttttctggtaagtatctattttaactaagaagtaatcctgtaaaatgcatcctgcatgcactactgctttaagaagtaactcttctctagtgaattatctaattaaagtctggaccttaatacttcagtgctttacaattacagatacatatttaaaaattctgggggagtacataatctggttatagaattatctaggctgttaaaattcatacattcggggttcactaatatttcaaaaaatacaaactcaaagaaagcacagtctgggaaagttactgtgttcaaacatgtgggactctgagttcatcctgaaatcctcctgccttctagtgcccatagaatactcacctttcctcgtttgtagttgctgctgctgaactgccttcctatgtaaccttctccttactacacagagatattaaggcattaaaaataagttagtatcaattttggaatatttcttttgggttaaggcaaaaattgaaaagtccctaggaggtggacaaaaaggaaggaaagaagtaaacacaagaaatatttttggaagccagtatttacaacattttttggtgaaagttactaatgtatttatcaatttatcactaattaaacaacacacttttatttatttttttattttttatttttttttattattatacttcaagttttagggtacatgtgcacaatgtgcaggttagttacatacgtatacatgtgccatgctggtgtgctgcacccactaactcgtcatctagcattaggtatatctcccaatgctatccctccccactcccggcaccccacaacagtccctagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattttgaataatgccgcaataaacatacgtgtgcatgtgtctttatagcagcatgattcatagtcctttgggtatatacccagtaatgggatggctggatcaaatggtatttctagttctagatccctgaggaatcgccacactgagttccacaatggttgaactagtttacagtcccaccaacagtgtaaaagtgttcctatttctccacatcctctccagcacctgttgtttcctgacttttttaatgattgccattctaactagtgtgagatggtatctcattgtggttttgatttgcatttctctgatggccagtgatggtgagcgttttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttactttaattagatcccatttgtcaattttgccttttgttgccattgcttttggtgttttagacatgaagtcctcgcccatgcctatgtcctgaatggtattgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcagatttctcaaagatcagatagttgcagatatgtggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcgatttgtagttctccttgaagaggtccttcacctcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacaacaacatacttttaaatagcatctttttattttgaaataatataactgtattatagagaatctgaaaatacacacacaaaaaaagaagatagaaataatgcctctatccacctccgttttttagagaaaaccactgttaatgtactggtttatctcatctaattcttatttattgttattagtatgtaatattttttccacttatagacaaaattataaaaatagtataacacagtttactatcatgaacattccactatgaacattgttccttgtcttaaatatttctcaaaaacattattttaatggctttaccatcttttcatgtggtgatatcataatttattcaactcaatatctttaatatttatagatagttgacagattagcactctcactattacaaaaatctgtcctgcaacgaacactaataaatatctgtctttgtttattctcagttaaattaatgagactgaaattatgggattatatattttttacattaattagtgttcttgatgcatattgctaaaatgcccactagaaagcaaagtaaatgtatgcttccccagtaaagagaaataatttaaggttccttttggtttatgatgctattttataggacacgaatgctttttctaaggtaaatgaacaaacataaacaacaaaattatttatggataggagaatctgtgatatgttagcaatttctgattccttcttacactgaaagctctgtgattcatattcactctctaagtgcaaatatctaagctcaagtcattgagaaagtaaacctattttaaaaaaaataaacaccttcaatatcaaataattgccttcattactctggtaaaattacactaggattaatagatgagtagaattagcaagcgatggagtaaaagtaagtttctcctcataggagttatttagtgagacttattttaaaactgttactacacaagacagtccttaattgtaaaacataatggagtcatcatttgtatctattcacaggtagtttatttctatagaaataatatcatgttctcattttaaactgcaagatgcaggttccaaccttcttctttagctttgcattcatttacaacatacaggtaaatttgaaacatgtttttagaattggtacctatatatacttgtattaagattatggactcttctttagttcagtgggttcctgcatgtgcctgttatttatttttactatcatgagataagtatctaagacaataaagcaacctatttccttatggtgtgttgactggcaaagaatccccttgcacatggggaggccacaaagtagaaataggcttagcatggagaaaaagtaaagtgagtccctatatatttggcaaatattaggttgaatgtgagttaagcagttttctctattataaggctttagagagattttaataagttagtgtattataatttatcaaatggaagaaaacatagttattgcaccctgactttacttgagacacatcactgtttttttttttttttttctcatggatctgtgtatggtctagaacaaaaaaacatactttgggcagtagtatattaggaaaatactatgatactaagtaaaaagatcttattctggtcacctaataatgacgcacatctgccgaacttcatgtcataaagcagtaatttattgtgatcatagattctgcagatcagggtttctagaagggcttggctgtacatttcccactcgaaggcttaggtgattgatgccagatgtgggggctgcagtcatctgaaggcctggctgagctgggagctatactttcaaagtggctcattcacatggctggcaagttgataccagttgttgactgagaacctcagtttttccatgtgtagctgtccacagggctacttccatgtcgtcatgagagggcttaaggcttcccccagtctaggtaatccaagggagccaggcagagtctgcaacactgtagccttgaaacccataaaccatcactagcactctagtgtgtgtcacacaggcacagctgtgattacaggtgggaaggaagcaatgaggccatgaaattcaagagatgagaatgactgatggctctctcccttgacacagatcctgaaacaaaggaagtaaattgcatgaagacttggaaaatgcctcaggaaatcacgatagagttctgaatactagttaggtgtagtgaggttaggtggctttgaagctggctgaatagccatatccagagaactgtgattaattgatattacatgtgagagcctccatggatcgatcagaaacctatattattatgtattattaatattttcatgtctgtttcttgttctatacactttaatgagtttaaaataaatagataaaagtatacttatcatagttttgaatgagcaaggtagaatagagggttgatttacagataatctatataatcaagattacagataacctaggggtggcaatgctgactggagttcaaatgattaaacttaacagtgtttagagtgaatttaagcatgcattttataaaaatctggctcccaaaatgtagcgtgaaggatagtaatggacacactaacttaagtaacgttattggccacagctcagtataaattcaggctgtcacattaactttaaaaacactgataaatttttaggttggttaataaaattaaactacctagaaccgtgtgccaatactgcagtcaccagccacatgtgtctattgaggacttgaaatgtgagtagtccaaattgaggtaaaaattgtacttcccagattttgaagacttaataaaaaacagaaaaacataatattaattatgtatcatattcatgatatgtttaaataatatttgggatatactgggttaaataaaatatattagtaattgatttaaccagttactctttattttctatgaacatagctactgaaaataagcttacatatgctgggtttgggttacatttctgttgctcagtgctgctcggtggatacaggaggtggatatatcagtgttctaagggcttattggaaaacacctgggatactctagccaattagaggctgtataggagacagtcataattctcaaagatttagcaattgtgatgaaggaattatgtaattgtggaaaaggaaaactctggaaaatatgggaagaataatagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggtgagttatgttgaaatagttaaatttcactgttttccattaatccaagaaggataacagttttacttctgaaatacatcataccataaacacaggaaaaaagagatgtgactttccaactaatatgtcaagtttgaaatgttgcagcttatatggaccttgatttttcttgctacaaatttcaatcaaagcagtagactttgttccatgtaatcgtatcttttttgaaaagtatcaaatatggaataacttttcagagaaccgtaacagtaataattcttagtagaaacagaaaacttcaagttaaaaaaaaaaaccacaaccagatatacacacagagaagaaattcagaagtaatatttgctaatattttctaattataccaagacagcaatgttatgattcctagttggagtttatactaattaattttcaattgttttcacgctgcctattttaaaaaggaaaacagttaaaggttgtgtgttagtaaattaaccagctcaaagagagtgtatagtgtgggggtctctaaatagaaaggaccttagtgtttctgaggaaagaagaaatgtagaatataattagccatgaggtcaacacagttttaaaagaccttggccagaaaatgaccaaggctttatggtcaaaacatttatactttatttttcacagcaaatttttgttaagatataaaatataatctactgtacttgaaatagactgaagtattgcattatgatgcttaattctacttacttaaacttcatgatgtttaattaaaattcacacacatttttcttcccttttcctcttgggatcatttaaggctaaaactggaacttaatctgtgaggtaaatccaacaccaagtacagtgtatgtgcacattatagtcatttgtttgtttctttaataattgaataagtgggggaaacaaagcttgtctatattgggagaaaatatgcattttctgcatcttcctaattccttttcaagagacttgtttcaaaataagagataccttacaggctgaggaaaagctagtggtatttgtgtgaattttgatcttcataaagaaacattaaataatctaagttattcgtgcataattttgcaccttaaactagttttgcacctataattttgcacttaaacttgtgaatactgtcagacaatggttttcatcatattttctttctggataaaaaaattctgtccataatatttcaaatacaaaaacattagcaattttcaatccaaggatatcactttgttattattacttttctcttcataaagaatagaagagcacttttttgcagttgaatttcatttaatatgtatgcctgtatagtaacacattctgagggagagcattttattaataatttacattttctttgtttgcagattgaatgatgccatgagaacaattaatggcatagatgttcatttactctccctcataatttctaagcaaaagcatttttgtatttattgaagggatgcaaaatacaggcatcttgtaaaagatactgtgaaaggggaaattttctaaataatgaatgttgttaatagtcatgatgtttatgtagaatataaatttaaaacctataattaggttattgtggattatacctgtatttattagttattcacttataaaatgaattgtggtatttgttttcagaaaaatgttccaaattatggggcaacatcccatgccccaaaaaatatcctgtttcctgttattggagagttaggttaatttaaaatttcccactattataaacaatgttgcgatgatcatccttgcccttaaaactgtggctgcatttctgataaatcactgtatcaagtgatattaattttgtagaggttattgaggcatattactgcatttcattccaagaagtttcaaacagcacttcctctagctttgtgtttatgtgtgttggggtgtgtgtatctgtgtgtgtgtgcgagagagagagagagatttttaaaatttaaccttttatgcgttattagttttgtggatgagataattgcatagaaagttcagataatttgctaaagatctgctggataataacagagctgggatcagaatcaaaggctcatgatattagccataacgttaacatgatctttttatgttaaaatactaggttaattaatcataaattcattcaataactatccatggaaagcttactatgtaagctttctcctgcactatatgccatggatatagcacagaacaaaacaaatgataatcccttgcataatagtggggagagataaagataaaagaaaataaataagtaaattacgtagcatgttacatggtggtaagtgctagggagacttttattttacattttatttcacttttacttacttttaagtacagactcacacaaatttgcaaatgagtatagagacctttgtattccttacccatcagcaaaatccccccagtggtgacatcttgcatacaaatagtgcattatcaaaaccagacaattgactagcataacataattcatacaattatagatcttaaacctgtttttgcatatgctcattttctgacatgcctttgtgtgtgattctatgacattttttattatacgtaactaccgctaccatcacaactgagatacagaactgctctgtcaccacaacgaaaatctcttttgcttcccctttatactcacatctctggctacttatctaatttctggcaacccgttttccatttctataattttgtcatgttaggaatgatatataaacagaatcatgaagtatataattttttgaaattggcttattttatattgtccaacataatgcccttaagttccatccacattgttttgtgtgccaagattttgttcctttccattgctgagtagtagacagtgacatgtaaagcaaaaaggaagatgccattaaaaagggtgcagttttcaatgcagtggtgagcaaagaggcattccacaggaaatgacacctaagtgtcgacctaaggaagtgaagaaagattcttgtgcatatttgtgggaagagtgtcctaggtaaagggaatatcctgagtaaaattttggagcagccaggaagcccttttggcctgagcagtgagagagagcacaagcattaagagatgacattaaaaaaaaaaagagagagatgacattgagacccattttaaagccctgtagactctacagtttgtggtaactgcagtaactgtataactatggtgattgtattaggtgactcaaatttcccatgacgttacttctaaactctgaagagattgaaagaattatcccttccctacgtgtgtagcaaaatgaatattttataatagaaaaatagtttaattgcaattttatcttttaaaaagatttccattttaaaaaatggaatataaagaactttatattccatttacgaaatgttgtgtcagtgttgtcaaacctttaagtaactttggcatgagacgggaagcatatattctattacttttcatcatccatgatttttactttgtgaaaacctcagttgggggatgcaaaaggaatagaatttactggaagaacagagatagcacctcgtatgaatcagaggacattgcatcacagttggggtcctcagcccagcagagaatatcacagcaaacactaaatagacctgccagaaaattccggtcttccggtccatttgggcagttatgtgatctaagtcaagtctcagtctttcactctatcaaagaataaaaagggtataagtcattttgacaggtctcaaaagcatcttagtaaatgaacaaagctcaggacatcaaagttgacgatgttaatcaaagactgaattgaactggtgcttgggggactggcagtcctaatctgattttcacaaacatgccaatatcaataaacttgcaggtaaacacacagccaaataaatagaagtgcattcatttttgctaaatactagatatttgatttctttaattctgtactatgtaattggaagcttacattttggtgttttacatgtatttctaacaccgcatataaactctttaaaggcagacacatgctgggtttttttttgtctccctcacatgcctagaatatagaatcagtatgtcttcagtcactagctgtgaaaaaaattcatttatctgacatcgaaaaacacaagtcattgcttttggttatgtgtgaatgtcgctgttgctgtaaataaattcagacacagtcaatgagcgttaacatttgattgttattccttctgcttataacaaagaactatgagatgaaatctaactgccaagaatcagtaggggaaagtagtcattgtgttaatttcaatgctgcggtgtaaatttcattaatattaaatggatttttatttaacaattgtaacttcaaaggggacaaaaaattaattaccttaacaaattgaaaagtcttcccttccgctgtacaggtaaggaaaataattaaagaaaaaaaaaaacaatcctgaagaaacactgactctcacatgcttattttcttcctgaaaatgtgagatagtaaaaactgaggaataaattaaaatttgcttctaatgttataaaattttgtcacaaaaaccataataaaaatgaaaatttcttatgatatttgtagaatattcaataatccttgagaaagtgtcaatatagtcagctttctggaattacaggtgtatgctgttgttatagttttaatttcttgtttttacatataaacctcctgggctaccttcagcatatgtgtccatgattgacagtaaagagttgctatttctgcaagtcttttcatgccgagatcaattttcccatttagtccatattaattcctaagtattcacatcttacaaaattaagtgagagagtgtaatctcaattgaggccatgggaaatatgagcaacctggtcaaggttttaaacctgtcatcatggattattttgtatttgtccctgagttcattctggcccaaaatctaactgcccatcctacaactacttagttaagcctttcctcccatcaagagtataactctggttataggctttaagtctggcttattttaagggtcaaagctaaatcaggccacttgaatttagactggtgtcactcgctgttcttaagggcaacataacatatggcattcaagcatatcctcctgaaaagactgaactttacctacagaggggtataaactgttcctcactgctgctggtggtggtgaattgatttcaaatgtagggttgcttatagttggaggatgtttccttttgctttattttggttcgtattttctgtttgttaaatacagaaaagaggctgtttatcctcagaaagtttttcttgactgctgcctaagttgttttctttcttctgggttaaagaaggttttctgggatagttaccgagaaatgacagtgatttttatgtcagaggggatggtagaatacctcgatttattactgaggcccaaaaaagtcaagtgacaaaaaaatctaggcagcggcagagtctgacctagatgatatgtttccaaatgctcaataaaagactgttgtttaaaatactccatgtcaatggcaaaaggaaaaattttattctctccaaaaaagttggtaaaagacagacatatatcttgatctctttcaaatactaattaccttgcatttctttcacatatctactcattcatttttaaattattaaatatgaggaaatgcggtaggtaatagacataaaaatagttacatgtaattcctgcctttcatttgaagagttcacagtgtagttgggaaaatttgtataaatagaagaattacagaacattagagcaaggagcaaagaaaagctccaaaattccaagaagaaggcatcaaaactgttatgaagattgggtcggagttttccaatatttttttctttttaagtgggaagatgccttcaggcatgtacagaacagagccatgaaaggtcatagtgtgtttgcacaacagtgagagacttggtgtggtaggagagttgggaaataaagtctggaaatcagaagtttaattcatgtatttgctaattattttcaatccctgaagttagctgtgatgaaattaaatcacaaatccccaaatcctcaagggctcataaatcctcaaatcctcactggctcacaaagactatatgggatttttacatcaggaaagagctgcctatttgttggttgagaatgctgtttttatatggcacctccagtcctaatgagtttcacaagatcacaggaagctacagagtctcttgtgcaccctctgacctaggacttgcagtaaaagtagatgtcatggtcccccctttatttaatgttttcatccttgatgctcagggcttttccaacgcattcttgaccttgctagttccgtttctatttgagaatggacaaaaaaggcaagaggaagctctgagcaacgcctagatttaggaatgactgaccctcttagacttaaggtctaaatctgcattcggatttgggaacatctttttggttttccacatctacaagacaatgacactgatgagttccattctctccctttccaattggccactaaaacatctatcaaaggtagaacagccactacctacttgatcagcttccagccagatgaaatgtcttttgttgacactgaaataactgaattatttatcaagctctgttctaacccaaaattacgtatgtatacgtaagtgtatatacatctacatatatatgtactttttccttatgcatattctgcagttgtatttgccagttgtcctcaatctggagaaatcaaaacctatagctaatcaatgggttcctttacaatgggatagaaaatgtattttctttcttttccattcatttaggtttctctgtattatatctaccaatttttctcaacaattttattcctcatttattttcatgctgataatgataactaagaggattttctactctctttggaatgagttagataatcatggtcctgataaaatataggtgttagggtaggataaaaaggaagacattgataattaaacttatcaaagaccagcaatatcacatgcactcagcttctttctttgcagatagtcaagagcttagggagtgttatttgaggaactaaaggtgtaaattctgggaagactcatcaaagttggatgatatggtggacagcatgaaaatgtcaggtaccttgggaaaacagacattttccctgtttcactattgtgagacaggtctttccagctcctcccattcttgatgcagaattgctgctctatcacatataaaaatgcaatttaattcaaatgctaattattgggtacctactaatagaattaacatccgctgagcctgacaagaaatgatatggaatccttagaagctatgagcctggcctttgaaaagtttataactgatatttttttccttgacttatttttagttgtgcgtattcctctttatccctgacatgaaatgtcacctagtatccatttccatcccagtattgccctacagaaaactctgggctctaagcaagacatgaatgataacttaaaattcccagcgaggtcattcttcatctttcactttgctaaataattgtggaacagtattttaaaagctatctggcaataacatataaagtagctttagaatgatgcttttgcagtcacagcactaaaacctttttttatgaaaacttcaagatttgtgcaaaagtcactttgtaaatgagagtatttaagacttccgtgatacgatggcagcttctattaaaacgaaaacaaaatgctttatctcattttgcaattttaaagtttgtttcatagctccatatcagatacacttttcttaaaatggcttataggccaggcacagtggctcacgcctgtaatcccagcactttgggacactaaggcaggtgaactcttgggctcaggtgttcaacacctgcctgggcaacatggtgaaaccccgcctctacaaaagaattagctgggcattgtggtatgttcctgtagtcccagctactggggtggctgaagtgggtggatcacctgagcctggaggtccaggctacaataaactgtgattacgccactgaactccagcctaggcaacagagtgagatcctatctccaaaaaaaaaaaaaaaaagacataaataatttcattaaggcaaatgacagaagagcttgcatattttctatttctttacatgtaagatgagcacttatctaacagtcttaagtagagttggcatctttccttaagttagatcaaaatcgattttgtttgtgtttagatattcaaatgcattttgcttaataacccaattagacttgaaaatagtgctagaataagtatgtgattttaacttttgcacaataaaaccttgattagctagaagaaaactaacaagaaatatcaattaaccagaaggaacaaaattataaggcaagctcaaaagaatctagaatttagaaagccgtatagaaaatgtggaagaaattatgtgctgaaggttataagcaaacatctaatctgattcctctgttttttatggttacataatcactgtttagatatttaaatcttctgggatcatttaagcgagttttctcctatgcattagatccttcttaccaaccagaaaagtggaataaaattatgacagtatcatcaacaaagactgaaagaaaagtttctgatgattattcaagtaactcgagtccagcagaacctctaattttcctggcattatgctaaaaatacatgcatggaggaggtgatagtattaaagacgagtttcccaggcagacagtttaggacacagaagtacagacaaggcctcggcacacacaggagtattctacaaatatcagtatagaaagtcagtgatgcaatgaggagcttgtataataggctttagctatattatcaacagatttcaagacccattattacttcaaacaataaagactcagaaaaagatacagttccttgcctccatgaatttaccatctaatgatggatgaggaaggagttcagtaattagacacataaaacagccgttgataaacatcataatgatgtttgatatgtccatgatataaacacatgtgaaatttgagacagctgtatattcatttgaaaatagcattcgcctccatctcaaatacaaatagtcttgcttgattctgtggaaatgtggcagtggcatcatgtgacaaagtttaaatatctgtgtaattatcctcttctctcaccaaaatgtaatgttctcttgattcttctatttctcttaaaggtactactacctatctaacaaagcttgaagccccggttatctttgtagcaccatcaccatcacttacccaattttgttttgatatcaaggaacccagctaatggttccactgcaaatacttaatcaggcctcttagttccctcctttgctatgattccagaagccatgtctctattactgccaggtacattctatgaaataatggctttgttgtttggatacattgacttgctgaaaatcttaaatggtccagtgccttctgttaaataatgtacaaactagttaccctgatatcaaagtctatacggtaggcctggagctgcctttctgacattattttctatatctgtgctgtgtttcctttctaccccaactgtgtgtgatcagtcttctcccagtccaacaccctttgtcctttcttgtgaggttaactgcactcactcacagatgttccttccttgatctccgtccctttctatccaactttttctatccttcaatgtttagtccaaagatcttatcattcatgcattctttccctattctctcatttcaagatgactgtttctgtcactgcactcttttaccactcctttggtttattataaatattggtctgttcattccatttccacaccaccacactagttagaatctctatctttattcaccgggattgctacaatagactcctatttgatctctatagccaatgtatcttacttcctctctagtccattctctgcatagaaaccagaataacttgtttaaaaacacaaaccagtcactggcttaaaatcaatcattgacaccacatttagaataaggtctcaatcccttaaagctctacaatgatatgcaagctctggcttgtctccctctctagttttgtctttatccaccgtccatgctccaggaacatttgatggaatgcatttttgagtgtattttatgccttcttacccaaccttcacacataccattctcccaactgcaatgccctttttcccacatcacacacattcctgagccaagtcactgtgatgatgtgattctgcttctcagaatatacaaatcaactccatctatgcagctcaggtagaattaattccactcaaatcatttgagtcatacaaaaagggggagagacagcttcctaaagggaagtccaaatgctataagaaaatgaaagaataaatgctagtcaggcaagagtgaaaatccactacggtcagtaatggctcttataaaaatacatagttatagaatctttaatatgcatgtgaagtatcatgaattacatagtgaaatatgcatgaaaaatgaagaaaactcatcattgtacatggcatgcgtatcatccaatggctaatgtagctgagttttttttgtcaagttagaaattttcattctcataccaatccctgtaacattgctattgtcattgcatctctgaaacatgttttcagaatgacagctataatgaaatatctgatgcttacaaaatgtgctcaaaaccatgttcatgggaatatgcatagcacattatttaaacagatgaagtctccagtgcacctcacaacccagaaatatccccttcattttctaactactttttcatgcagaaactgaccctcgttcttagtttttgcatgaaatttacagtagccatctgcttaggctgtgacctattttctttctcaacttttctgttaaagagaatcaactataacgcttatttaaaggaatgtgaataagctaaatatggggttgcagctggttcagactctctattgaaattctcatggcctggtataatttaagatctatttatgtaattgctgtgaagtcggagaaacaatcaaagaaagctgtgtgttacatcattttgccaaaagagatattgtgtttgtctccttgtttaaagaactgaactccgtagtagtaatctggcccatccacagatgtgcttaggtttaccctcacaatgttaatgcaaataatgactaaaacattcaaaatataatttattgtcaatatttaaaaattggggaattttatattcaaaatcatattccttttttttctcttgaaaaattggaagatctggcaatattggcatatggagacattttcccatggtaaccattggttcactctcacagatggggcattctctcttcaggtaaccttagcactcacaatttttaatagtttattcttgcagacttcacttgcttgtagtacctgtcaagcttttgtagacatttcagattgtaataattgcttgtcacaatgggatcctctcaaacaaaagatttggccaaaatgaatagtataaggagtacattgtgcaatataattttaaaattaagaacaaattgctcttgtgggcttggctatggctatgatatgggtagcaagaacttcccaagactgggctgtagttaaggctctgggtgtggcagtgaccatgggtcaagctatggctgtggatacagctgtggctatggattctctctccaatgaccatcaaattctcaaagctgttgatcattttgctgctaatttttgactttcaaacttttcatgcctctccctagtattccatgatgaatttcaagatgctcatgttgatttttcttacatttctctttattccttatggacagtgaaagataacatgacattccagtttgatcttctgcctcttgggcagtttccaatattttggtacaatcgacatttaagcatttgctcatatactgtcaaactatgggaatccaatgtatctatttgtatatatattttatttatcatacttcctaatgaaatgtatttacatttatttttaaaaaaggacaaatcactcaagttacaacctacaacaactagaaatcttttcagctacaagtacaagaaaactcaaacacagttggttaaaaaaagctagttattaatttcaaattatatctattaagtaggcagctaatttcatttgttctgtggctctacaatagcagccactgcgtttctaattgcccttaatctttcactgatgcctgtgaccttgctgtaagttggctaccatagttccaggtgtgccacacctattccaagcaaaagagtagattgaattaaacggcaaagggttgcattagttttgtttgcaccctttttatcaatgaaacaaagtatttccatgaagtactacctaggtgactttaattaaagtaaatccctgtccaagaggaatgagattataatgattcatttaaaacaatcataatttatccccttggaataacacagcatttgtcctctctgagattaagttatctcccagagttttcttagcatagaatctgggaaggaggtgaagacatttgtgtaggcaaaggacaaagtctgtcacacaagcgtctatgctcccatttactttcaagcaattttactctgaattttgtcttgtacttcatgaaggctccttccagaataattattgcctcacacggaattattatcaaaccaatcaatatttctgataaatgaggctgctgagctgttcattctgtaggttttattcatctccccttttatcttggattgcagtctaccttggcatgtgataggtattttgaaggaggtggaagatgtttctcagacgaaattattttaggatgtgataaaacaggggcaaatttttaataatttttaaatgtgtttttgttgacataaagagcacaatgcaatatgtattatcaataaatattcatcaatattcatcaataaattaaatatttattaatgaaaaaccttactcagaaacctcaagatcatgatttaggctgggatagcattaaacatgtattaaccagagacataaggcagggaagaccaaatatctcaataatctcttccattgctttaagttattcttcattctttgattttagacaagaaaatattacacaatttatgcaaaagttacactttaaattcctagattttgaggtcttaagtttgaaactaggtttattcagctgtggtgactcaaaagaagataagagagtggaggactcagacaaaaacgtccctgtagttgtcatcgcctagcctgagaaatgattggatttaaaaggaatttactatgctgaaagcaactcagattaatttaatgtgaccatttcaatgtacactcttgcattattcatgtactatctagatattattattttttatgcaagtctacagtcatttgactttcaaagtatatcctgtagatatcctagacctgatacacttggtataaattatggaattacaccataacattaccataaatctttatattcaaatgcagattgtgtctttctccatagctattcttcttgctcatctaaataatatgaagccaatgtaaattagattcataaatgaaaattatcactattttcaggattaagaagtatattaacatatattaataagctgttttcaaatctgtcatttcatacattatagtttttctcaaaaaatgtgaaacttttttatttgaaccttgaatgaataaatataatgatatattaaattagcataaaatattctgattattgagtataatacgttttcatggtcttcctacaagaagaaaaaaggatcctaattagatcaggacattgattaaatgcattagtgagtaaactgaagctagtatttactgaacaaatggcatattatactttatctgcactatgatctttgtagcaaaataatctattgattgttttatatagaccacaccacaaccatgatttggattcatggctgtactgggaagatgcttatatagatgtttcttttggcactcaaaattatgctgagggttttttttttcttaaatgatttccttagataattcttattatactattcaaacaactttcaaaataagtcactgaattatttaaactgaattattcaatgtttcaggtgaagtgaatactggagagggccagattcaggttagcttctaagctccgacacctatctctctctctctctttcacacacacacacacacacacacacacacacacacacacaccaaattaacacctttctccaggcccataatcactgaaaaaccctatcttgctttaataccagtgattactaaagtgtctactcccaaaactactatgtgttctacctagaattttgaccctacattttacaagtttcaggcagttaaaattggtcataattgctgaaattatgtcacatgtgaaaaaatgggatgcaaatcacagatgtgtccttatacctgtttactgtaaggacagcaagcagagacaagagatagagacaagagaatcaagtttctatttttagttccattgtcactgtcccccaccaagacatccatttatcatttctgaggacaccagcagcaatgttattcctgggtttacaagtacatctgaagactaagaatttgttcttgggcaacatcactttgaccacctactgatttggggtagatgcactaaataaatcaaatgcattcattaaatcaaataaatcattaaatatattgattatagtagccccagtctatgctgtgttcacaaatccatgctggtatttcaggagatttacataatctcataccccaaaggtaacaattattaatggttgctcaggaatccttccgaaaacatctttcttcttaagcacacatacaccaacacacataagtcttttaaaaatacaaaaggtctgtatactctgttctgttctgcaggcagtcttaataattttcatgtaatatctttccatgacaaaacacaagtacagggctcttctttttcatcatatcactaaaaatatacatttccttggtttatattgtagtctcttccccttgtgcaacctctgcctgttttactgaacaaatcactcctgacacattgggttgagttatctgctgatgtcctttcccataaatgttcccttctaatacaggggcagctctaaatcttaagctcctgttgagtactgggagaaaatatctaacttctgcattaatatctaggttttcacacctctaaactagaaaggacatgactatagcctgatgtcaggatctcattacttttcttctcttactttggtatctgatgttccaaatggatattgatggggaaatttatttccaatttaagaatcaagagcaaaaattcatcttctagaatatattatttcctattttatatgctctttcctggaaacttagaacatgtgtagaggaggaaaaactttcctctgccctcttacgtttggagctgtggcatgtgaattaaagcatacaaattgtattaatgtttttaattttacatgcattggaaccacacagaaaagaagtgaaaaacctaacggagttattagactcaggggcttatatactactttaacaaaggattatatatttcggaaaatgactaggaaatatatgggaaaactacgatgagaagagttatttagtaaggtttgtttatgcagactcatctctcagtactatctttatttcccgtaacgagggtttttgtcttcctgagatgggagaagggaacatttccacaaggaaaactaatgtgatacttgtagtcagaaagtgggagggcagagagctcttactgtttctgatttctctcaattaccttcagttataaaaaatcattttccaaagtggtatattttggtgtggcatatttggtcccttcatatgattatgttccttttttctatctaaagatggtatcccctaagtacatccttgaccttttttaccttcttatattagcacttgaggaaataccaaaaataataaatcgtataacctattactgatgaaatgtgtatgtttctttttgtcatgtatgtgtggtggaggaggtgcatagaggatatttctctgtaacttctagcttctttattggcaagcaaatagattggcaagcaaatagatttatttctgtgtgtgttttcaagtcattgtgattagcatggactacctttgaaatagccatttgagggtccccagagtctataatttttgaaataggaaaatttcaggatattagtatttttctgagtttaaaagcataacctaaagttaacttgtaggctttttctttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgtatgtggcccaggatgactttgaatgcagcccaacacaaattcataaactttcttaaaacgttgtgagatttttttttggcaggttttttttttttttttttctcatcagctatcgttagtgttagtgtattttatgtgtggcccaaggcaattcttcttccaatgtggccaaggaaagtgaaaatattggacatccctggcctagattgtgagaaaagagatcccattacatttatgaatgggctgtgctgaaaattgacagcaacatcagaatcctaattgtgtgccagcagaaacagtgctattagattttctctgtgcttagcaaaggatttagttagggcattcactttcaagcacccgttctatgcattacacactctcatactgtcttaaccaataactatttctataaggacattctggtgaaattagtgtgtccaataatttaaactaaaatggtgacatctaatattttctcctccaaggtaacgtcagcatttcagagcactttcactatctgaaaacggccaaaaactgatagaagagctttctgtttacaactttatacaccatagtaaagttctaggatgcaaagcttgcacagctttgtaacataagcattttatgccaaattaggtgaggataataagatattgtgacatttgcccaaagtcacggaacagtacaaaactcaagatttgaacaataatttttctgactacaagaatcattccatttctgctggctaaatcaacaatgaaatacaatagttttgcattgcgacttagaggtaccccatgtattccactaaaataatttgtattttgttagaaattaaaatataaccacatgaaatatgtctgtgggtgtctctctctccctctctctctctgtacatactgaatttctaggtgtaataaaatgcggtcagaaagagttcctgcggtaccacattatttttttctttttgcaacatgacactacactacttctaagggctaacaaattttaaaactttcaaaaaacatgatgagaaaattgatgaaagcctaccatatagaagcaagaaggaggtttgaagtgcctttcaaaacagattaccagtctgtcattttgacaccacgtaagatggccgtagaattatccatcatcgagagtttcttcatcaagaaccctaccctccatctgtatagagcttgcaaactaaagcactgccttgttcagagtcttttctattgccttaaccctgtcttcttgtgactgcctttctaaattccacatgaaagtccctttctcaaggtataattttatgtaaacttttgagctgactttaagatttgtgggcatattgtggaaatactcagacatacccagcacatttttccagatgttccaggtgttccagaggtcacagctccatcatggattacaaggcttttggtaaagaaagatggatcaaggttagagagtaaaaaaagaaaggcctactcctatttgtcacttcctgtgaaatgcagaggctcctacctaggaagacatttttcaggtgctgagaggactcttgggattttatttattgtgaaagtttcatttattttgaagtatcattctaaaaacaagattaatgctcaaaatggataatcaacattatctggtacaaaacacatggacttacatgttaaaggtgttgttctttccttatcatctctgggaacttggacaagtcaggtaacgatgtatatattttataagacaatatattgtatacattacatgtacatttgtgtgtgtgtttatgtgtgttctctgagaagcagacccaaaatggtacttgtcctatttcaccctgaaaacaactcccaggagacacatggcctcagcatgaacctggcagtggattcagaggggcagctggatccaccatgcaactattggtcagccgctctccataacaggatctcttgaaggagatctaagtaatgcttttccatgtgccatagtgtatgaaatagaagatctgcacataatttagaactatgagagaaggtagctctgtacattgcaaggactcctgaagatctcattcaatgccgtcattgaacaatggcacgagcagttattaatgaaaaccattggtcagagactttaaaacttcagggtacccaagagtacatttcagcgtttgctaaaatgctattaccaatctcaggaattaggatttaatgaataagtaatgaggatgaattttaacaagcaatcaggggcatcctgaactgggtggtctctataccacagtctgaaaagtactgaccttcctaagcgatgtagaacatacaaaactgtactcattatagtatattctacttaagtggattatgtatgtcaggttttcatactaaaaaaaaattactctggggaattaagagttattttcatttattcagaaaatcatatatagtctatgatattatacaactgaggcatcaacaaataggtaatttttatgaaagttcagaaaggcagtagggacttgtaggcatttggagggcttcattttcccatgtcaattggtatctctctgttacagtaggtgccattatctactttaattgtaatgaatcactgggggaattgtatttgtgaatgacaggtactttcttatgcaaatgaattgcccgcagtgagctagtttagttgatcaagctttccaggtcaagtagggcatttcccagatatgataaataaatatcttgggagctaaagaggaaatcattacagcatatcattctatctgaatttcaaaaagtatttttatatttaatttgttccccaaatactttccagattgactatatatactatttcttgaaatattcactacattactgaacactatcatttttgtgtcattcagcctcacagaaatgttacccaaatgggatgagtgctccagtgaaaatatgaaagccatatgaaaggcaggttcagtataaatgcaaattgctttatcagaaacattgtgaaatcctccaaaaggtactaatttaaagttagtagaacacttttaaagtggcttttaatgtcaatatccctgtaattgtcagtatcctgaaaatagtaattatgacagaattataatttaacaacagtagctttcttagtttgatatatttgagtgacctaattaaagtcattcttaattgttttaccgtttgatttctatgttacaaacttgaatgagagactgctttcttggtgcttagttaatctaggataatattaataatattaaaataatagaatagaacattagacttcagttttgtttctattaataatcaaagttattagtttgtggtttgtatttttgttttcataactgtgtgaatcatacatttattttccaaattatgtgcaacctgattgaggaccccttttaactttacagccaaagtacccagatggcattctgaagtatatcttacaaataacaaggtcaaataaggaggatgcacaggccatttgacagatataatttgttaaaactttatgtttttgtggaaaaccttataggaaataatttctaatgttctaatgtaagcttatgttagatactctgttagacattgtctaccaagcttccatggttttagaatcctgattttactctaactgtgggtacttacatatgaatctacagagaaaagtcctttctcctgtgtgaactagtagggaccaacgactttaaattctctctctaagacttgaggtcgccgttcaaagaactaactgctgtcaaagagcccacagtgtgttcattacttttttaagatacgacaactttgggaggctgaggcgggtggatcacgaggtcaaaagatcgagaccatcctggctaacacggtgaaaccccgtctctactaataatacaaaaaaattagccaggtgtggtggctggtgcctgtagtcccagctactcgggaggctgaggcaggagaatggcgtgaacccgggaggcagagcttgcagtgagccgaggtggtgccactgcactccagcctgggcgacagagcaagactccttctcaaaaaaaaaaaaaaaaaaaaaaaaaaaaaaaaaatatatatatatatatatatatatatatatatatatatatatacgacaagctactgatttaagggcaaggaggagacgggggaagtatatttacaatcttcaaaaattatcttgtggatactgaatacctaaaaagaaaagctcacagtgatctattccccccacccccgacctcccacctaggtagtttggtagtttctgctgagatcagaaattttttttttattctgagacagggtctccttctcttgcccaggctggagtgcagtggcactatcatggctcacaacagccacaacctccagggctcaagctagcaaagtgatactgttagcattcaaaacaaagaacaaattagtaatgggtgttttaatattaaactcatcttactgtggtcattatgaccattaactcttccgtacgaaagtattttgaagtgaatcatcagggactctgagtcagtggtcttgtcttgatgtctcacaacatgggtgcctctatttatttagacatctatcttcaccactcactttcaagtgaaagtgaaagagcaggtcatcaaatttcagtattctgttattttttgcagtcgggagccgtatggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgagacaggagaattgcttgaacccaggaggtggaggtggcagtgaactgagatcacaccactgcactccagcctgggtggcagagcaagactccatcacaaaaaaaaaaaaaaaaaaaaaaaaaaggaatctcaaggattgaaagactgacccattgcggtgttatcacgtccaaaaaaagtaggcatattcacatactgttttgagagaattaggaaaattttatgagaaagttatttggaaaacatacaaaattaaatgtatttttccactcattttcaaaatgtactttagcacaagaggcctggtgcatagtatatatgagaagtatttaaatgaagggatacattttgtatgatttttcttacaaattcattaaagtatttcaagtaatatagaataattatttaaccagtgttgcaatggctattaattttccttatggaaggaaaatagacaaagacgtattattgattttcttcttaatctttttaagtttttttaaataaattggaaaaatacaagtttatatgtagatttacttatatttgggggtttaaataaatgttctgcatcgctttgccgcttctcaacttgccccaaagcaaaacgaacacttccatggtgtctcttggaactcctctcctttcatctcccaaactgtcctatatctttgaagtcgtttctgaatatatgcctcatctccttcctttctgtgaaatctgacagtttgtcaaaaacacaaccctggtagccttttataggtgatgacaatgttttattccatttcccacatgttatagagccagtatataaagtaggtgctttacttgttcctcattgctacttcaaagtcatatctcaccttttctgcttcaaaaacccagaatgtttgaagctcaaagtcatcgggctgtacaaatccttcccccttttcattgttataacccactgacatttgtcattctctgccattcatttaaggctgtagattctggctcgctctttctcttcatctctacctctgcctctattctagtcaccttccaaatccacgtggccttaaaaccacaggctttcaatcccttgtcttacttgtctccaatatattttccttcaccctaactcagatgatcatttaaaggttgagaccatatgctttttcatcactcttatcagcatccccctaagatcaatcatgattccaaaagttccacactcattttttctgtctcctgatccatggttaaaacaacctcacatttgtcaattgtttttatctctttttaccctctatcatctcctcctattataataaacatagattaccagtccaaaattataatcactttcttgcaaacaaccttaactattttacctttgtctttttgaatcatgcttatctatcaaatctgggttttattcagtcatttgcttatttttatctaaaacataatctccccaaaggtacacttatattactgaaaaacactatttcagtttcctactctgcatgattattttatatcttctattgtctacataagtttaagttggctttatcaaaagcctttctgatctccatagccaaggaagttccatagctattgatttcaactcattggtactgggtgatcacagggaatctcagtgatcagagattaggtaataatatcttcccggtcaggaaagtttgaagccagttggctatctttctttctatatgacagttattcatacacgaaggtgtgaaattttcaactacctttcctggaatataattcatgggtatgtatcagtaacaatgtatgtctccttttatgaacatcatgggcaaagtatgaaaacaaaacaatcacctcttaaacgtgtcaatcagttaccatagccaagtgcactgtgacattatgattgtttcagagcggggagcatttgctgtgcatcattttatcctgaatgtttttcctaaccctgactcatggtagtcgtcctcaatatgtatttatttgaaatgtatgttttattttcctgttagatctcgtaaatatcagacttccgaggacataaatctgttaaagccttgtctcatgtttattgtttttgtgtatctcttaaggaaatgatattttgtttttatattttctgatccgaaaagagcaaaagcccctgcactcgagagagctgttacaatcaaatgagaaaatggaaaggcaaataaagaagatgtgattccctacagctgtgaacagtgatgtggaaaatatagtggcttttaggtaatatagggattcacatcctgtctctaccacttactgcttgtgtagcattgtaaaaacaacactaaatctctctcagataattaagacacggaatctgaaacacagtgggcacttgatacatgttatccctttttatactcctacctcttcgtaaggaaatatttctgagacagaataaagttcagaatcaaagtaacaagatgcttaagccattttgacagaaaatagcaaatatgtggaaaacataacaaaatatcaaacacttatataggttaagggggatgtgcccaagagctggaagaagagagattttctctataaatgattcagctaagaaattatagaatgataatatgaagctattcatctgtattcaaatttttatctaaatgcctaagattgacatgcaatatatgtttgctcttaaccatttgtaggaccttgataacatttaaaaataggtttacattcattcatttcactctccaccacattctctttttgaatctctctctctgtgcccccttctggaagcctcttttaattacttttacagagtggaaattgtatttgttaaaatatgccagccctcgatattcaaataaacatattccaattatggaaaaatgtgagatggaatatatttaataaaatgaggtctctaattattttttcactgaaatttgatcatgtcttttttttttttttttggtcttagtttttaaatgttttatttttattttatttttatcctgactgtctgcatcctacttgctcaggtaaaaaagtaagacactaaaacttgtttaaagataaactattaacaagtgttaacttaaggaaacttctagaatattttccatttggaagtctatttttcacggaaatagagccatgttgtttatgttaatttgtacccagaattttctgcttactgaaacgtgatagaaagttctatttcaatacacatatatctaactacatcattcattttcaaagaccttgtggtattccaggatataaatgtaccataatttatttagctaatattcttgaaactttttgagatgattcaaaatcaaatgaatttttagtcataacaattctctgaacatttatcacacacagcctagtgttttcaattgttttactcaaaagagaaagtcttgaaaaaatacatcagatggtaaaatgtcaatttgaagcagtgttttccacattaaaaatattgacatttttctctttgccaaatttaactggcaatttaaataacatttctgtattcatttgtcttttattgatagaagaatcaatagtattagtcagttgggttagagtgggaagagctggaggtctggaggcaggtcctgggcttagacgtggcctttgatgcttgatgttcaaatgctaaaggcattttccctgttttcattgggagagggtgagtgattactggagtttctatattctggcaccaactggccttcttatttcctgtgacacggagagcaaaatcatgaaaatgttatataccagaagcagagaattctctcctacctccaaaaagcagaagttagcaaacactgagctttgtgcgtaagtatgtgtgtatatatgtatgtaggtgtccctgaagataatttacatttttgttttatatgttttgaaactgttgaatttgaaacaattttagtttataagaaagttgcaaaattatttaatgaaatactataaacccttcacccagattctctttcactatgttttatgtacatacacatttacatacattaatatatagctattttttctgaaccaactgagaataagttgcccacattatgcccttttagctccaagtacttttattgtttatttatcaatggcattcacttaaaaatcataatacattgataaaaaagaaaattaatgtacgtaaaatgttatcaccaagactagaggtcatattcatattttgccaattgttctaatgtcctcaaggataaaaaaaaatcctggtccttagtctaatctagattcacacagtacttttatatggcatgtctgttttgtctttgtacatctagaatatttccataatctttctttgtggacttgatatttttaaggagtacgggacaattattttatagatgctgctccatttaggtttgcctgatattatcttgtgattaggtagaggttatgggtttttttttttgtttgttttgtttttttttgtttttttttgttttttttttttctttgatggagtcttactctgtcacccaggctggattgcagcagcatgatcttggctcgttgcaacctccgcctcccgggttcaagtgattctcctgcctcagcctcccatgtagctgggattataggcatgcgccaccaagctcagctaatttttgtattttttggtagagacggggtttcaccatgttggccaggctggtcttgaattcctgacctcaggcgatcagcccgcctcggcctcccaaagtgctgtagttacaaacatgagccactgtgcctggtaaaggttatgtatttttgacaataatactatcgaagtgatattgtgtttttcaatgtgcaacaaaccaggagccacataatgtctaggggttccattaatgatagtagttacttagatcatttgattagggatagtgtgattttgtcatttaaaagtatttataattttctgtatataaatatatcttatatacgttttttcctaatgtttggcatccactgagttttcttgactgaaaaaatttatgatttttttctatatggtggtttttctcttcatttttttctatgctaattaattactgtaacaaagcattttccattctttcccatttattcattcatgtgtttatttatttatttatgttactatagactcgtggattcttattttatcctatgtcttataacatattactattaagattcgttttgatgatccaattttctagatttggccagtgggatccagttcaagctggctcctgtgtctttcaaaaaaagtcatcattctaggaacattgtcttattttttgttactgtaagtttttccaggctcattttgaacatatcctgctccaattcaagaatgaagtatttatccagtgtatttccttttagtaaagaattatattaaggcatcaggagctggtcttaggtatgctcattgctactgtaatgacgtgtacatacattttcaaaatatatttaaagacactttccagtatctgtctctagctctttattataatccattaattcataggatattcccattctcatttaatattacagggtttaattttgccatcatcctttctgtgtttttatattcctactttaacattgagaaacctggattccattacccataatgtatttactatttcctcagccttataagagacgtaagtagtttgaaattgctaaattgtgccattgtgaaaagcaaaccgactcattacatttcaattaaaaatttactttaatcagagagtatatgtcaaagtacagatttcaagtactatttggtgtcttttttttttcttttcagcacatcttgactattaatttgaaacacggtttttctcccatgcttgtagattccagggatttgtttttatatgtgaaatatcaatatataattctaaaatttaaaatgatacaaaaatgtataataaaggaattgtcaccgcttctcaccttttcaatccatttttaaactcttattcttctttccaattctcaccctctccttacagataaccagactccttagtttatctttccagtgtttctttttctcacatatctgcaaatacattatattgtatctccttctctgttacagaaaccttagcatccctttgattccttttgcactttgcatttttcacttaatgttgtagtctggatatcactccaaattacctcttaaagattttctcattttttttttttttacaactgcgtaggactacattttatggaaataggcaagtgtactcaacctctctaatggataagcacttcaattgctttcaagttttagcgattacaaacaatgccttcatggataaccttgtttatatttttgaagttggatcattaaggaaaatgtcgagacattcatttccgagtcaaaggtaaatgcatacatagttttatttatattgtcaaattctcccttataaatgttggaccaatttacattcacaatagcagtgtttgagtgtgctagtttcccttgaactttgccattgaaatgtgttgtcatacttttaaatttttgttaacgtgaaaggtaagaaatatttcagtggctcacgcctgtaatcccagcactttgggaggccaaggctggtggatcacctgaggtcaggagttccagacaagcctggccaacatggtgaaacccagtctgtacaaaaaatacaaaaaaattagccaggcatagtggcgcaagcctgtaatcccagctacttgggaggctgaggcaggacagccacttgaaccctggaggcagaggttgcagtgagccgagattgcaccactgcactccagcctgggtgacaagagagagactccgtctcaaaaaaaagaaaaaaaaaaaaaaagactgggagcagtggctctcgcctgtaatcccagcactgtgggagactgaggcgggcagatcacgaggtcaagagattgagaccaccctggccaatgtggtgaaaccccatgtctaggaaaaatacaaaagttagccaggggttttggtgtgcacctgtagtctcagctactcaggaggctgaggcaggagaatcgcttgaatccgggaggcagagcttgcagtgagccaagattgcgccactgcactccagcctggcgacagagcgagactccgtctaaaaaaaataaagaaagaaataatatctcagtatattttaatttgtatttttataattgcgatgaggttgatctttttttttttgtatttttaaagttcattttttgtctatttttgggggtgattttgtcttttgctcatttttctatcgcgtacttggtcgttattctaaatcccatcactctcaatttttttttctttcatgtttctgctcattcccatggagttaatctgggtatgttctccacttatgcttcgcccaggctaagctgtcagtcagtgcagctcattctgctacccttctgctagccctgtttccttgtcacctaaaatacactttttaagtttttaataatgttgagtcagcattaacagaataaattggccacattgggccaattagtgagaagtctcatttctatttttgtggcattttaatcctttcttattctgtgtttctgtttccttggtgtcaatattcttatatggatatgtgatagtcttccttagtgtctttctactgtccatgccataacaaagttcctttctttgctaaatgtgagatgtgtacaagtaatatcttacatggatactttgcaacaattgcatgctatatgtattttcaccaccccttagttcacagatgaaaaaccacgttacagagagataaataactgaattcatacagcaagtaattgatacaaccaaattttcaaaccaggcaacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagttcatatattaagtaattacaattctgtggtgtcattggtcttgaaaattaatttatatttaatttgttatatcagatattaattatacttggtagaaggacaagaattaatacagaattcattaataaaagagtgtgctggtttattttaaactatccttagattgtatctacgcaatcaagggatatttttggtctatttgatgcgagaattatatgatccaaactgaaatgatcactggggaagtacattttcacctgataacctttatttaactgacacaattatatcaggcatgaactagtacaagtatgcattcacagccacagccatgtgcatactgcataacatctgccagactggaggcaccatgagtcactggagtaaaccaggagcttagctgacattgtcacatggtcattatcctttattattgttaagaattaattttattacaaatgtgaactaaaactaatttgaaataaaacactaataaaatgctaattaaataaaacacatgccagtactagttattaaaattagataaaaataatcagaaaacaaatttttatatcatcaagtattgtttaaatcaagtttactgtgattgaaattaccttacggttatctgtgtgacacagagatgaaggctgatcgtcaaagaaaattctaggaaacatactttttctgacgttgaaaagttgctttctgaggagtctttattcctgcagagaaatcaacacaaccgggaaactcttgtctctcatgcctgctgtttgcttattttacacaagtgacattcatcatggcttagttgatggaaactgagcaatgcttgaagttttaagactacatctgcagagcccaaataagcagaaagccttaaaataatctcatgaactcaatatagtcaggatagaataagccaggaaaatcccaaatccccatttaacttaatcaccctaacagttttaatggcacacttgtaagaaagtaattctttactggtgcccaacaccttctgtatacttcattaagggtaaaatatatggttgagtctttcacatagtccacacttcagatcgcccagaatctcattctgtgctcacatgttttgtgtgaagtttggaatcagtagggttttcctttgaaagaactcactcctccacctgccatctcgctctgtcatcttcaggtgaatgccaaatattggttctgagttaatgctgtgtggtgttgttattctaacatcccaacaggaaagtgccaattaaagggaaaaagtgttgaaaataaagttattttgttaaaagaacatacgtaggaatgcttctctcttaaatatagttatggatcaaaatacagaaattaagtgtttgcataatggaagactagacaatttgaatgaacaaataatgtaactataaatataataataataacacagaattgttattcagtatacttgtattttacatactgccttgtagggttatttccagtgattaacgtatttcacctggcatttgttagcacacaactgactgccaccaccacaggacggagaggggagtcggtgggcattaaccacagtgtaaatcaggttgtggaaatgcagaggcagtcacttgccttggcactcacacatctaatgtctgaagaagccaggacgagttcctatgttgtacattctcagtctagtttttcttactggactcgataaggaagcagaataattagatctatggagatattaagtatgagtcaacacaatgcaaaaactatcaaagtagccaatcactctttgtctttgattgttgccaacatcttttttctccaactcttattttggattcagggagtacctgtgcaggtttgttacctgggtatattgcatgatgctgaggtttggggtaagaatggtcctgtcacccaggtactgaacatagtacctagtagttagtttttcaaaccttacctccctccctcccccatatagtagtcaccagtttctattgttgccatttttaaaatccctgagaatccaatgtttagctccctcttataaatgagaacatgtagtatttggttttctgatcctgcgttaattcacttagggtaattgttgccaacatctttaatcagagatgcaatgtgtagaaatatgttagcaatggaagcatattgaaaatggacattgatactgtgtcattttgttctctcttaatgacaaggacctatctaagagagttaagttctcctttgttccaaaacaacttgtagagttgttgttcctttttttttttttctgattttagaaaaaaatatgtgccattatggaaaacatgaaagtggagaaaaatattaaaagaacaaaaatcacccatagtctcaaaaccccaagtccattccctgaagcatttttattatactttcctccaatatcttgtgtgtgtgtgtgtgtgtgtgttttatgaagtaaaattatgcagtcctgaagggaatataaagcaaaccatttcacttttccaaactaaattattacggaccatttttctattgaacaattacatcactcaatttaaatacaaagtattttacccagctattgtctgaacaaatcaaagctgtctaattacagtattgtatattgtacttttttaaaagcttgatatattcaaagatcaaaagcatgtaacaccacacctgggttgccatagagatgtctacattttatcaagattaaaaaaaacttaacaataaatgcatttttataggtatgctaaagacttaccataacttaaacacccacaaacattttttttttttgcatcaatattctgggaaaaatacaggtgcaagatattatgtgccttttaaatagcttcattttctaaacttacgtctttttttcttctgatgcatcctttccactcacctattttttagtttagaattgtcagtgaaaaagttatgtttttcaaactctggaaatatggcctgccaaactgatagtgtgaagtatggagaaaaataatgtgtatacacacattgcacaacatgtacatgtacatacatgtatatatgcacatatgtaaacacagatatgctatatgtgtatgttatatgcatacaaatgtgttttttatatctgtttctactctatgtatatacttacaaacagagcacaagcatgagattcttaaaatgtacataggacagaataaaggtcatctgatctagataagagtcatcatacatattcatagctctgaaattatctgagagtttggggaggatatttctctagggacctttaaccttaatgtcagggtgttgatttgacaagcatctctaaagaatccatcactttattagaaaaagcaaagtgtaacattattatttttttaacaacccaaactttaaaaacctttggagtaactcttatgagaaatacctgacttttgtaagccatgactacagaatttcatgttggcagtggcagaaaagagagtgcagatggagaggagcctagctttccatctgtcatagcagcatgcagaagatacactgcttattgcttcagctgtttctaaatgctgagatagagtcttgaaaaggaacaaactccaaactcatggttctttaagcagaatttgtcagctggattcaaaagaagcaaaaatgttagcatgatgaaataatatgcaggtagagcctgagaaaacctattaatatcaagtaggaaatagaacagtcagagcatggtatagtcatgttattgaacagagatgtaaaggggagaactataaattcttactgctgaagtactagccctgcaggacatacagactgcatgaagcccaggcttcctgggattttttttttttttttttttttttgagaaggagtcttgctctgtcgcccaggctggagtgcagttgtaggatcttggctcactgcaagttccgcctcccgggttcacgccattctcctgcctcagcctcccgagtagctgggactacaggcgcccgccaccacgcccggctaattttttgtatttttagtagaggcggggtttcaccgtgttagccaggttggtctcgatctcctgacctcgtgatccgcccacctcggcctcccaaagttctgggattacaggcgtgagccactgcgcccggccttttttttttttttttttttttttgagacagagtctcactctgtcacccaggctggagtgcagtagcgcaatcttggctcactgcaacctccgcctcctgggtttaagcaattagaggtgtgtgccaccatgcccagctgatctttgtacttttagtagagacggggtttggccgtgttggcaggctgttcttgaactcctgtcctcaactgatctgcccgccttgacctctcaaaatgctggaatgacaggtgtgagtcatcacgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccccatctccaccctagaccctgtctttccacctcattttcaggattaattagccctcttcctccttaatagtaccctctcagtatagtcatatctcttccctgaactaccatgaaatcttggaaactgtttttctcctaccagtcttgtttctttatcattccccacatttaattctgagtaattaatgagacataagaggactttttgtttttctgattaaaggtctatcccaagtttctcatcatcttgtagtaagttctccatggcttggttctctctacttcagctttagctcctgcaacacttcctgcctctgattcagttgctttccccatgtttaaattcttgtgcacctccctcttgttcttcaacacttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagaataaacagacacagctcagagatgcctagaaagaaagctctgtagaataagtgggactcctgcatggtttccctgagaactggttttgctaagatcatcttttgcccttcagttttattgtacagcaccttcaacattaccttcctgtgattgaccatacatttagaagaatccttcagttgccctgctttaagaacacaatcagttattttagaaaggtaagattgataccaacatgaaaggctgagcagctgtaccgagtgcagagaaataagagtcacctcaggcatcaaactgttcatagtcagatttagaggaaatcaataaataaacttgctcatactttactatatttagttttgattcattggataaaatatatctttaaatatcatcataagaaagtgagtgtttggtaccattttagagtttgaatttgaaaaggatttcaagtgtgaggagtcgttctcctctggagatatttcacaggcaccatcattagtgtcaagtggagcagcctaggggggcccctttacatttattgtctttgttcctaaaagatcaaacgtagtttttccttgtacgtacagaagctaggagcttgccactttctcaggaggtgctagctctggctgaattcaatttgtgttcagaactgcccgaagcagaatttcatacatcaccagctcaggatctcacccttgcaattatccatgttgaaagactgtggcaggcagaataatgatcccccaaaatgtccacaacccccagaacttgtgagtctgccaccttttatggcaaaggggaattgaggctggaagtcagttgagagagcatactggattatccaggtgggcctaatgtaatcatatggacccttaaaggcataagaggaagaagaaaagccattctaagagatgtaataaagctagaggaagtgacgcatgagctcaagaacgtgagcaccctctagaagctgggaaataccttcagtcacagtcagcaacaaaacatagacctcagccctacaactacctgcaaagaactgaattttaccagtaatctgaataaacaaggagatggatttttccttagagcccctagaaggcctcctcactgtcatctttattttattcttctgaaactcatgttggacttgtgacctatgaaactgtaagataatacatttgtattgtttgaagctactgactttgtggtgatttgttactgcagcatggaaaagcaatacaatgagctatcaaaaacattgatcaccttatccttgatagggccaggaatgccttaaagaatatcacaatctaattgccaagaaaagataaaaataaatggaaatttcaacaatgataaaggaacaagacagtattttgagacggtaattggttgaatggtgtatagcagtgcatgataaattggcaaataaattctgctaagttttcagcaaagtcttaatgaaaagtcagaaataaatgagtctcaggttcctaatctcaagaatattttagacgctaagcacagagttgctagatagtcttatgaaaattgcttcatttaagagaaaatggcatatcattaagttgaatatttcatgatattgaaatgtagggactccagttgaatttgtcaggaaaatgggaagaaggagactgcatgagaaccaaacttaaatgtacagattggaggatttgaaaacggttgagatggagaggctttccagaagagaacaaattgatgagcatttcagagttgacaatgtctacattacctcctgagacatcaaggtcaatgcacatgtgccgaaagccactcacaaaattgaagtccatcctccaactccaggcccacacttactcacaagcataacttcctcacctcaacagtgggcagtacataatttctgaaaatgagacaatacagagtaatctctcatgcatctttctttgatgtaacagagaccagcctgagttgtaataaatttagggaaagcattcactattattttggtttctaactcttctcaatctgggacaaaatgaatgccactgaaaggcaagaaaaatactcagataatctctcttttccagccaaatatgggagtattgaaggaacaaggagatgacagataaagatgcttttagagcagctcctaatgctctctctctctgttcctaaatgaatatggccaaggctgaggaggtttctacttatgagaaattgtccctgaaagtactccagctgctcactgactcccaggcctaaggatagtcagtctagaggaagatgctgcgtctaatatctcttcctgcctagggttccgtagagtctagtttctgtggaaagccatgtatggcgataaaatgagtgtgatcctcttagcaagaaggcatgggtggaatttctgccttccgtgtttgctaataaggggacttcatgccaattacctaacctctctgggttttagttttttcatttgtcgatggcactgatgatattaatggagcctctctcagagtaagcacttatggatttttgtatgatttttaatgcgatgagataaatcttcagtaaaatttgaagtattataaaatgttagtattcttgtagttattattgcattaattttctagggcttctataataaagtactgtcgattgggtggcttaaacagcaaaagcttatttcctgtggttctggaagctggaagtttaaggtcaaggtgcccacagggttggtgtcttttcaaggtgcccacaggattggtgtcttttgaggcctttctctcgggcttgtagatggccattttctccttatatgctcacatggtgttccctttttgcaggtatgtgtccaatatttctcatatgagaactccagtcacattagattagggctcaccctaatgatttcattttaacttacttttctctttaaagaccctgtatctaaatgcagtcacattctgaaaaactggctgttaggacttcagcatacataattctagggggacacaattcagctcataacattattacaattattaattccagttcagtggttaaaataatatttttgcattatgacagtcataactttatctattaaaaaactgaatacctatttcacgttcctttgaggctttataatcacaaagtcaccacttctcagaaacaaaagcaagctggcagccttgctccactgtctctcctttgctcaaatggccactgaaaccagtgccttggcctctgtgggctttatcacctttgacatgaaatactctcttcacagtataatctcattttttgtgcaccataagggaatccatttgaaatgtagaagttgactccaatgacaaaatacatatgaaaaatagtaactttctgtagtaactctaaatttccttctgggaaaacacacaaacgtacacgtgtacacatacacacacacaaccccccacccctccaactgctaaaattttcatgcctaattgatattttccagaaaaccatttaagctgctttcttctattatggcttctctcctaccaggcacagaaactgtactgaatattagggataagtttcagtagccccatttgcattcagtcctcagacaagcgaagacatggacagtgagtaacatttatcctggggaaactgatcaagaaagagaagccacctggataaaacaagtcaaggaaatttgcatactcagaaccatgatttgagatgctaatcattacagaagcatgttttattggtccatttaatttgatttggagagaaatctccctaaaggatttggggattttgcagacctaaggcactgacatacagagtaaagttggattttactatattacttgtccctatggaatcagttcatcaaggctgctaataactaaagcagtggctttcaaacttgaatggctttaagaattatctggagagcttgttaaaatgccacaggctcaaggaattctaactcattcagtcctgagtgggatctggaaacctacacaatatcaagcccgcttcctcaccccaagtgattttaatttttctaaccaacactcacatagtgtttattatatgtcagacactgttataagcattttataaatgttaacttatttcaagtcacacaatttttacattttttttcccattttttacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagcaaataaaaataataaatgaaaaagttggttagagtgtaatatatccacttgtcacaatcattttagcagctttagaaatgctattactgaaattatttatctggaatcagttatttcatcatatcatttaatttccaattgatcattataatcaacattattatcataactgtttttattgagcacttgttatgggcaaaaggctttttgcattatcttattaatccacccaatattataatattataataatcctctctgtctctgtgacagtaattcttcctatcttcctcttcacatgtgctcctgcaggcacgctggcttccctgtggatctatgaacattccaggcacatttcggtctcatggcctttgcatctgctgttctatctactggaatattattaatcatgatattaataaatgaattcttgcattttcttcaatgattcactcaaatatcaacactttagtgaatccttccttttccatatcatttaaaatttcaacacttccctaatattttctttcccccttcattgttgcctcattcccatcttacatatgtcaattacattttttttcccttaaacattagtttcaagaggccaagatatttttctattgggtgtattcctgtttagcaacccagagaagtgtgtcagccatactgaggcctcctttaaatatttgttgaataaacacccattgttaaggtacggaaaatgaggcctagagaggttagatcacttagccaaagacaagtttcgggaaagtgtcaaagcaaatatggtatcaggaaattgcctgtagggcctaaattctccgtacgtctagtcagctgggagaaacctgaggaacataattgagtttcgtcttttagagttttacattctagagcttctatgctcttggtggagaagctgatgcacacacttaatggctctgatttttgttgtcacttgtgcccagcttaactatggaaaagaatttgatttcataagaataagtgctcttagtagtagtactagagacacacctcccatttgcaaatatacttgctattttcctagtatttttacatacattgtttcattttacttcataatgggacagtaaatccaggttcattatcacctttgtgtggatgaggaattggaagcccttttgggttagtgattttctcgaggtcatacagcaaaaatgtggttgtatcagaactagggccaaggttcccaatctctgacctgatttttcaccaacaattttcttgctcagccgctcatgctactatactctgttatacaaaataactcttctaaataaataaaccaatgctggccctataaaattataggtatggtaagaacagtagtctcagtggtatctgcaaattcctgtattacttcattaattttactcagcagtaccaaagggttttaggaagttgagcaagaagaccccctggtcatttggggacagacatttaacaataaattgagcctgaatcttatagtccccaaacctgacttcctgagtgaccaagcagagatggaatttaaggaacaagcatcttccctgtaagtcccatcattgtgttcaccacaaattacaaatacttatatatgaaatatgcatctagaggcgttaccagtggcaactccatatgggtctgggtctgtagcaactctattcttgccttctttgaggaaagaatttggctgagggacagaaggcagagtgagagactgaggcaagttttagagcaggagtgtaagtttattaaaaagttttagagcaggagcaaaaggaagtaaataaagtacacttggaagaggggcaagcgggtgccttgcgagatccaagtgccccatctgacccttgacttgggtctttaatatattggtatgttccaaggtttgggtttcttctcccctgatttttccttgtggcaggctgtccgcacgcacagtggcctgccagcgtgtcggaggtgctgcatgctcagtgtgtttactgaagttgtgcccatgatcacttggcatttttcccttaccagtcgagtgctgcaagaagaaggtcataaaccagttaaactctgccattttgcctgttactgcacatgcttgagctccacttacccagctcctgcgatctcatcaggaagctgctcatcaccagcttcaggtgtttcccatctattgggagactgcctttccctggcaccagctgcaaccaattattattttagagcaagtttgacatctgcccaaccgtctgctaatggtcacctgacatttctgggagtgatgctctcttgccctgctcatgtatgcctagatacctactctaacagaggtattcagttccgtaaaataatagatttgttgtcattgtcagtagccatcagttatgttttatatttccaagcagtttttaacttcatcacatctcttaagagcaacagccgtatgtaacttttattattaataacccagtgatgttagtataagtaataatctccttaattaccacattccaaaaaaatgtctcggggttgttaatggcttatctaacatctcacagttaatatcacttattctcttgaatgcaagtctgtgcttttgtcaccacattgcagtggggcaggagaaatatctggcatctactaggaacttagttgacatcagctttctctttctaattctctcttccctataattaaattatcttatcatcttgcaactttgtgagatgattgcgtattttaatctccgttttgatgaataagaaagcctttgtaatggatctcaagaagaggaatttaaatccaacaaacaaagagaaaatagtgcactgaatatttgcattgggttttatatgttccaggtcacatttcaaagttgcctttctgttagacttcatagttgtcagggctactaggaaacaagttccttgacggctcttttagaattatttgcactcagaattctttggttctattccagttatttactgttgcacaacaaatctatgtctaaggttagtagcataaaaccacaggattgcattctatatcatagttttcttgggttagaaatttgaataaggagattattgtcttccactggatattaacggagattgcttgatagtgttcagttgcaaacgtgctggtctggaaagcccaagaaggcctcttggtgccttggaaaggataggaccctcgagtagatggtgcctggatgagatggctgggagcctgggttcaccggggactgttgaccaaatgacacatgtggcctttgtgatatgatgatttcaaagtggttggatttcttacatggtatctcagggctcccatagagcgttttccaagagacaggaaacaggtagtgtagcaaaattagtaacaccacttccactatattctactgatcaaatagtcacatgcctgttcagattcagaggaaagaaggaaagaggtatagacacaacctctcagggagaaaaacatcaccaaatttgtggccatctttaatattcacatttcatgtagttctactctatgaggataagcatgctggtatctgatctggtcacagtctgaactgtacagcaaaggatgagggtagtgaaatgtggagtgatgagcattagaagatgctttttgcctctgaggaggatttccctaggcaaaaagtggaaagtagttaaaattgatctttgctgttctgtttgctattaatcttgaggtgaaggttctggcaaacatgttgaataactgaattctgctctagcaaacaacgcccgccatccccatatctactaagtttcctaagaccatgtttcccaaactgctgcaattctgtatcatgttgaccatttttaccatatcagggtccttcttgaagtattgtttaacttctttttctaacttaatttactccattttatttaagttttaagatacatttttcatcactcttataaatggaaagccattatcacttgtcataagtagagatacttctgaaaataaaaccattatctacagcagaggtgagcaaacgtagtggtcattggctaaatccagactttggcttgtttttgcacaatctgcaagcaataaaataaagaagggagggatggattatggacaagaaggagagaaacacagagggagaaaggaaagaggaggaaaggaagttgggaagaagggaaaaatggaggaagaaagaaagaagaatgtagcaaagaccatacatggcctgcgaaagctaaaatatttactgtctgtctcttcacagaaaaagtttgatgaccctttctctagagctatgcttttcttcttgcttgtccttccaatgcaatattatgtgcttgtgtttgctgcctgcttagaaagctgcatttgatgctgtgtggtgaccaacaaatcaatcatgcctcctttccatggtctagagttgttgctgagcagcagctgtccaggcgagggattacaattctgagccatggcatctagtggagccatgagaatggttcttactaatggtacataaacaaaagtgatgggtgtcattttgggttccaggtggttaaatactggttgcatgatccttcacaatctctgtcctctcatgcctttgtctgccagttgaaagatgctttgtttaaggaaataagatattttgcaatttacactatgggatctgatgaacagttgtcagccttaaaaacacatacccattaatttttattgtgtcccattggccataattataccaaaaatacatatgctggcgaagttatagtagcaataaccttattacagggtaactattatgtgggcctgtatgtgacagaaattggtagttaagaaataatactgattttcaggctatgagggcaaaatattgcttgtcaaattcattcagggatattttctgagtcccaaaagtagatgtgagctaagaagtaaattaatcagtttaggatttctattaactgaaattccaaaggtcttaatattaacaaattacaatgattaactcagacataatttcagttgcaggcatgggtaatccagataatggcatgttgaagacatataatagaataaaacccatgcagtactaaaaaataaataaatacataaaagtaggttttatttagtcaatttatcaaggttactatttgttgttgctaattgcagtacttttcatgtgcaaaacactgcagtttcttaaatgtgatgtcaattagcctcacattgaataaaaaaggtaaataagttttatcaagttttcttcctcctctttcccttccttcctttcttttttcctttttcctcaaagaaacaaagataccatacagtcaagtagcttgtccacagttatgtgagcttttctataatccattggtatcttccctaccatttccattttctcctcaagcagtaagccctttaattcatttttagtttatatttctagtttagtgattttttttaacataagcaaatacatatgtggacatctatctatctatccacgtcgccacttcctcacacaaaaggcagcaccctatacatagttctacactggtttttttgcttattttctatttaacgtatatcctggaaattgccatagcaatgtataaagatacctttaagctttcttacaatcacataataatccaatgtgaggatataatatagtttatgtaacttgtcctttttgatatgtatttggaggtgtttctagtcatttgttcttaaaaataatatcaaaggccaggtgtggtggctcacgcctgtaatcccagcactttgggaggccgaggcaggtggatcacctgaggtcaggagttcaagaccagcctgatcaacatggcgaaaccccgtctctactaaaaaaaatacaaaaattagtggagtatggtattgcatgcctgtaatcccaactactaggaggggctgaggcaggagaattgtttgaactcaggaggtggaggttgcaatgagctgagatcgtgccattgcactccagcctgggcaacagagcgagactctatctcgataataataatgataatatcaaaaaactgagaaaatatgacagcaaatgttcttagaaaaacttagaatgtatgataaaataccattgtcatacattctctcatatttggctacatactttggaaaagattctgagatgtaggattactgggtcaaaaagcaaatgcatgtacaattttgttgaaaaaatgccttattacactctctatgatgtttcttctgtatttcattcccaacagtaatggaagaaaatgcctgttttcccacaggctcaccttctttcccaagacaggattttggctgttttcttctgggaataaaatacttctcagtgtgatgctttttgttttgtttttgtttttgttttttttccattttacttgtttgccaatcctattatttatgcaaaaactacacaactttttttaagtttatattcccactaatcatagtagcattatattcttacttgagttttcattgcactgttctcataaggaacttgagtatcttttcatatgtttaaaacttttttcattttttattttaaaatttttgactgacaaattaaaactgcatgtattctaagtatatatgtgatgatttgatatacatatgtaatgtgcagtgattagcacaatcaaattcacacattcactagcagccatgctgcacattagacctccaggacttgttttataactgaaagtttataacctttgaccaacattgtccttttttcttttcttttttttctctttctttttttttttttttttttttcttttgagacggattctcactaagtcgctcaggctggagtccagtggcacgatcttggctcactgcaagctccgcctcccgggttcacgccattctcctgcctcagcttcccgagtagctgggacaacaggctcccgcgaccacgcccagctaatttttttgtatgtttagtagagactgggtttcaccacgttagccagggtggtctcgatctcctgacctcatgatccgcccgcctcggcctcccaaagtgaacattgtcctttttcctactccttagcctctggtaaacaccattctactctctgcttctatgaatttgaacttttaagattccacatgtaagtgagattatacagtatttgtctttttgtgtcaggcttatttcatttaacgtaatatcctccagttcatcaatgttgtcaaaataaaatcggtatcttgaagatacacttcgtgcacccccatgttctttgcaatctcatatttattgcagcattgttaataatagccaagatatagaaacaagattagtgtccactgatggatgaatagctaaacaaaatgtagtctatgtatatacaatggaaaattattcagccatagaaaagaatgaaatcctgccacttgtgacatatttgaagacattttaatgtctttccataaagtgtttgatcacatgttgtgtccatttttctttcagcttgctagttttattcttcaacattctttgaagctttaaatattaggcatactaagtttttatcagtgatagaatttacagtatctgagatataatttacaattaatctaagatccaagtaacaattattacaattattactctaagatccaaaacacaaatatttattgtagttggtcatattttgcttaggtatttttggcatgtaaactattatactttttaaaaacttatgtaaaaaatctattgaccttttccataatgcttttggaaaaggaatatatcatctctaggtaggtgtataaagaaaataaactgttctctttaatacttgaataatttctgcttatttgcatctcttacccattgggtatttgttgtggtatctgtgtgtaagaaatatttacaggctttttaaaacttttatgtttggtgatctagttcctcatatgccatgtatttaaaagttaatcttttcattaatgacttggaaaagcatattttcatttattcatatagcatatctttccttttagtgtttctctcagtttcaaaaatcattcagtctattcattaaccaatatttatttaataaaatttgtaatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatggaatcatgtgttgcacacacaggaaacaaagggtgtttttaaatgtcagtcccacatcaaaagatgcaaaggcaaatgcttttagtagcagaatttgatttgtaattgagctttttctcccaaacacaattctttttgtttggggtggggaatgaatttcagcaactccatatatgtttgttgaacaaatgaatgaattaaagaatgaactccatgaactaaaggcaggaatttccatgctcaagtttgtaaaatattcttctatacaattatagttagggcaaataacaatacaaaaatatattcaggtatgcctagaccataagaatggctcagactggattgtactggaaaaatgtatggatctgattattgaataaaataaattattacttgtaaaacgaaaaattggaaaagagccttagcagttgaatataaaatattaaagagtattaaaaatgacataggcattcattcacttgaccagtgttcgttttatgcctactacatagctagcaaaaatctatgatgaattactaaagtgaacagtgtttgtacacttaagataaagcatttagtaaccacgaaactcctgcttgaagtccttaaaaccatgaaatgtcaaaccaaacccagattctcagttgacagattgttgtattaatccattcaccaaaatgcaaatattaatagagaatgcatttttattttatcaatacatgctttaatgttgtctgaaatgtttggggaataaagaagagaagtaatggctttaaaagagttaagttcatgtttacccaggtggacaatcacagtctaaatgctgattaaaattttaggtcaacttggagggaaagaacctgagatcactcacagaattctgctcaagtgccttcctactttccgtcaataacgtcaattgatgtagagaggattttttacaaatataacttatgaacaatttaaatctggaagagcaagcaattatggtgaattctagaatcaatgctcagaatcaaaaggctgaaatgacacatcaaagctagcaaaatgaaatcaactggaatctaacaggttgacattccatgttttaaaaacataattataaaggtaattgtgcaagaagtcatggaataccaaagctcagaaacaaaagtttaaacaaaactttaacttgagttgacattaaaatttaaagtataagtaatatcctaagactggcattcataattgtgcagatattttccagtattacaatggatagtttctgccaaataactcatctaacagacagtcatgcatatcggtatctatactttcagatacacattttttcagcaaaccaggtactgtaaagtataaggccctataatgttcttttcattatctaaccctctaacactttgaagcacattaattctttttatctccctgctttttgtttccctctcattctgacttacattggttagccaaaggagcagcagagtattgcagtctgagattaaagtgaacctgctttccttttcttttttttttttcccccatatggtatttgttttctttattattattattattattattattattattatactttaagttctagggtacatgtgcacaacgtgcaggttagttacatatgtatacatgtgccatgttggtgtgccgcacctgttacctcgtcatttacattaggtatatctcctaatgctatccctcccccttacccccacctcacgacaggctccagtgtttgatgttccccaccctgtgtccaagtgttctcattgttcaagtcccacctatgagtgagaacatgcggtgtttggttttctgtccttgcgatagtttgctgagaatgatggtttccagcttcatccatgtccctacaaaggacatgaactcatccttttttatagctgcgtagtattccatggtgtatatgtgccacattttcttaatccagtctatcattgatggacatttgggttggttccaagtctttgctattgcaaatagtgccacaataaacatacgtgtgaatgtgtctttatagcagcatgatttacagtcctttgggtatatacccagtaatgggatggttgggtcaaatggtatttctagttctagatccttgaggaatcgccacactgtcttccgcaatggttgaattagtttaaagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagtattgtttcatgtgtctgttggctgcataaatgtcttcttttgagaattgtctgttcatatcctttgcccacttcttgatggggttgattttttcttgtttaagttctttgtagattctggatattagccctttgtcagatgggtggattgtaaaaattttctcccattctgtaggttgcctgttcactctgatggtagtttcttttgctgtgcaaaagctctttagtttaattagatcccatttgtcaattctggcttttgttgtcattgcttttggtgttttagtcatgaagtccttgcctatgcctatgtcctgaatggtactgcctaggttttcttctagagtttttatggttttaggtctaacatataagtgtttaatccatcttgaattaatttttgtaaggtgtaagggagggatccagtttcagctgtctacatatggctagccagttttcccagcaccatttattaaatagggaattctttcctcatttcttgtttttgtcaggtttttcaaagatcagatggttgtagatgtgtggtattatttctgcagactctgttctgttgcattggtctatatctctgttttggtaccagtaccgtgctgttttggttactgtagccttgtagtatagtttgaagtcaggtagtgtgatgcctccagctttgttcttttggcttaggattgtcttggcaatgtggactcttttttggttccatatgaactttaaagtagttttttccaattctgtgaagaaagtcattggtagcttgatggggatggcattgaatctataaattatcttgggcagtatggccattttcacgatattaattcttcctatccatgagcatagaacattcttccatttgtttgtgttctgttttattttgttgagcagtggtttgtagttctccttgaagaggtccttcacatcccttgtaagttggattcctatcctatcctattttattctctttgaagcaattgtgaatgggagttcactcatgatttggctctctgtttgtctgttattgctttccttttcattcctgacaggcaaggtgagcgccctgaacaacacagctcccctgatcttttccccctacctactaaagggggttgtcctcctaaaggggcactgaaaaatcactgacatgaggcagattgattgataggagaaaagatgtacaaatttatttaatgtgtacacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgctaaaaaaaaacaaaaaaaacaaaaaaaaaaacaaaaattagctgggcgtggtggcttgtgcctgtagtcccagctactagcgaggctgaggccagagaatcgcttgaacccaggaggcagaggttgcagtgagtcgagattgtgccactgcactccagcctggtgacagagtgacactcggtctcaaaaacaaaaaaagaaagaaagaaaaaagaaagaaaggaaaaaaactgaaaagtcctgggtatattaatggaaattctctacagaggcaaaatttttccccaaaaaagatacctttgcaaggccacttctgtttgctggcactgcagcaggcattttataatatgtgaaataaatatatttttggataaaatatatttatgtcttttggtacctactttgaaacttaaaacaatttttacacattaaaagccaagctgattgctttggtagaatttgtgttaagggtcgttagttagagatagccaaaaaagtagaaagataaattggtatatacagaaaagaacaaatttaaacatattgtttaaatcttctttagtctgttagtcatgaaaatatatcagttcagttaaacaattgtgtctcattccaagaggtggcattgcagatgggctttgcctttacgtgtgatgcaggcaaccagctctctaataaagcatttctatggaaacagaaggaaaacaaaggttgatgcatggcacggtgcctctatagactagcttttctagagtttctagggcatcctcagattgcaagggcaacctgacagattcttctggattgtaatttggaccaagagttcaagtgaactttctgagaaatccacacatcagcagggaggcatgaaggttgttcatatataagttgctattatttttttactgacgtttaagttgtctagcttcaatttgcagggctttaagaaaagcacagttttaatttctaataattccaagccagaaaaatggaagaaaaaatgggaaataaaaaaatgttagtttggagacttgtaacaagtaaagaattcagaattcagactaaaatgtagagaaaaaatgaaaactcaaaactaatggacaaggctagaatctaataataggtatatgactgtctcttttgaaacataatttttctctctctattcccccattttttaccaaagacaaatcatagcaggaccaatttatttgcaacacaagttttagtcttattatacttggcttgattaattgcttaaagttcaacaggaatcattgttcatataggcttttagacgttggctttgctggaacttttttcataaggaatctcagattggacttttaaaaacctttcaagcccagccaataacttacctctgcctgcagatacctattatgaagtgggtaaattcctctcttcttgaagtcctcaaaaaacttgagattcttaggcctgtcagaaagtggcattctttacttaccataggtcaggaaccctgcaaagtaaccatgtagacaagagaccagtcattccaaggggctattattggctctataaaatcaatcttaattcctcaaagcattctggtcatatctaaaggtatgcccttccagctgaagccatgctaaattaaccactatctctatttatgtcctgttaaaaatgaaacagattcttactcaacttacacaaataactatattgccatgaattaagaatacttacaaataatttccaaattctggagaaatcagacagaaagaaatatgcttctaagtttgtttacaagagtatatttactcagttgttaaaagctataaatagctcaaaagaaaaaagttttcttgactctgaaaaacaaaacataaagaatcagcaatgttttaaacaaaaaaagtcataaaaaattatttcagtatctaatagtccagtcccatgcaattaactcctgttcttcccgatattacactaacaatcctcattaacactttagctctccagtgaaagttctggaagttttttctctagtccaatggcacaatctccaaaattaacagaaacctgctttcaagcatgcctatccaggtcctttctatgaactccccataagaagcaagttttgtactctagctgatgataaaccactttttgaggagaatcaaagcaaaacaactgtggatgacaaaagtcttagcacagccatggtgaaagacacaattgacaaggaaatttggttacttctgtggcatacaaaaatttatcataatagatataattattactgacaacatactgagacatatcagaattatagaaatcccatactattttggaacacacactaataacacatttatataaatataacccaaataaagttaaacattattttatatttcacaatgctttctatatgattttaacataccaaataagctgaatatgtctttcaggggacctaatatctaaaaagctaatgaggtcaaaaagacagaatttgaaatttgattttggaaagtttgtcaaatatgtaagattttaaacatctgatgtcaaaaattaggcaaatattttagaaagcaaaaacatttatgctttgagaggagactcagtttcttaaacaataaggcataataaagatacgaagacaactgaatctgtctttctcttccctttttttgcagtttactcaacaggttaaaaaaaatctgttactatctcttactattaactgaaaactttatccaaaagagaaaacaaaattttacttttcaatagcatattattaatgctaaagcttatttcaatgaaatcttatgaacaaactcatccaatctcaaacagtttgaccataaagtaagatttttatagacccttttataaaccttaataattttctattaaagagcagatcaatgttccaagaaaaccattactgcaacacaaaggccctgattctggccctgtgtcagtgtgcttttgatattaatgtttaatttatagaaaaaatgaaataattccctttaaattttagccaacttgatcacaaacaaaattccttttttaacattaatctgccataaaccttctataacttacttaaaccttcagtttttttctaatattttactttaggacaaatatttcctttcctccccaattttctatatccgtttagttttatccatcatttttttctttaatttaaaacaattcttataaacctttaaatgagtcagaattactttttctttaacaaaaaccacatttccatgttttttataacctttttacacgtcctactttattatatgctttgtatatagaattgtttcttttatatctagtagttttaattttatttattacagtgttgactgtaactcttgtttttagtggaaaacctaggaggtaagcaattttaattatgtattagattcagagcccagaacaaaggacagagctgcagataatgccttaccctttcctgcatagccaggaggcatagctaggccaagaagaactcatgtctatttgtttagagcctagaatctaatagttgtaaaacaggcaagtcaaatatttgtcaaaaatatcacacataaatatcacaatttatgaccttaaaacacctagcaaaggcagtatctgacctgcctgtgtaattcagactgaatttctaaattaaagtctgaagatgtttccattttatcttaccagtaactttcaaaaactcttaatttaccaaagattagtcacatgaactatgaaactatgtgaggtaaaatttttatttttctgtttaaatatttgatttaagtattttttttccttaagacaagtaattagagctcttttacatattttagtaatgaaacatcatatgtgcttataaatgtgtataaacacacagacatacaggcagagaaacaaatcttcacttgtcatatttcaaagtttctctccagtattttagactatcagtctcttgattacctgttttcttctctaagcaattattagctaggcaaccccaaatgtgcaattctaaagggacagctcttgtaaaacaaagtagaaaatttatatcttagagtacaaaggtaaaacatttggcctaaatattgtatcatcatctgctcaaaccacgggaaaaaattatgtgagtaaaattcagttaagatgaccagagaaagcaccttaaacaaagagatgacttgtaaattttaaacaatggtaaacacttttaatgtacacaggtaggcaccctttcaaatggagatttccttaaatatgtaaatttcttttacaaaagagtgtcaggatagctagctaaatgctagaaagttgtattttggctattttacttaactcgtttcataattagatgactagcttcagagtggagccccttggtgaatatgggaagaaaagcatacagtttttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatccaaaaagagaaaaaacataaaggtcatatatacatatatatacacacacatttatatacattatatattaatatatattttatatgcattatatatatttcatttacatatataaataaaatgtgtgtgtgtagcttagatatcagcttttaattaagcagatttctaactgtagtgctcactcctcaaaaataaaaaaactttcaaaatcttattactggatttcagctgggacaaatagcttgtcttggcttttgaactcctttaccaaaggtctaaagcagtcctcataagatctagaaatatcaaatcaaaagagactaagtgattccttcatcagaccaactcttctgtcaatggttgagagaaagtgttactctcaaactatgattgtaaagttgtctatttctcccttgaaatctttcagatttttgaaaattctaaacttcagttattaggtatataaacatgtatgattgttgtgacttcctctcccttttatcattatgaaatatgtctctatgtttggtaatactaattattttgaagtctattttatttgatattattattgctacttcagccttctgacacttgtagatctttttccatccttttactctcaatttctctgtgtctttgtatttaaatctttcccttttggatagcatatattggggtcttatgggccttttttttaatatttgaacataatctttgccttttaacttgagtgcttagcccataaacatttactataagatacattcagatttagttctactattttattactggtttctatgatggtcatcttttattttctggtccttatgttggccatctttcattttttggtcctctgatctcccttccctgccttcttcttaattacttgaatatatttttagaattcaattatttctttactagctttttacctatacctctttgtatcattgttaagtggctgttctatggcttacaatttatatcctttataatgaacaatatataacagtatacttcaatttttgtagcattttgtgtaaaatatagaaaacttgcaatcatataacaggtcactatcctgtaattacagttgccatctgaattaatatacacacagattaaaaatccataaataattttataatatttgctttaaagggtaaattatattttgaagaaatttttaaaatagggcttttttatatttactcataatttaacatttttaatgcggtttgtttatgatgaaagattcaagcttttcatctggtataatttcctagtttctcttcagcctgaagagcttttttttttttcattaataacatgttttttggagtgtaggtttgacagaaataaatttccttagtttttcatttaaatatgtatttattcgatattaatttttgaaacacgtctcactcattttaaattatgagatgagaactttatttatttattttttacctctgtaaaggtttctttttcttccctgctctcttttgttcttcatgggtttctgatgggaagtctgtttttattccaattattacacctctaaaatcatatgttattttcactgagtagtttaaaattttctcatgcttttgactttgaacattttgagtatgattatctacaaaatatattctgaatttgtcttatttggcatttgctcaactattaaatttaacatcttgttcatttaccaaaaatggtagttatagtcattatttcttcaagcagctcttctgctccattttctttctctccccttctgggactcaattacctatatgttaaaacttttgacattgtctcatagacttcttaggccctgttaggttggttagaatttttaaaatctctctcatcttttggtttagtgaaatttattgacagattttcaagttcactggccattttctctttcatctcctttctcttattaagcttactcagtgattttatttcagatgtttatttatttcagttctaacatttcactttcttttttatattgtctgtatctttgctaagattttatactctaccttgaagaacaaagttataagaggtgctttactagcctcatacgataattctagcctctgcaccatcctgattggcatctgttcattattaatacctcgatattgggtcacatttgcagcctttctatattgagtaattttgaattgcatcctggatatcgtgagtgttagttatgctgaatatattctggattctgttctattttacctccaacagattattgaaggtgtttattttggcaggcaatttacttactgtcacacatatagtgcattgtagctcacatctcacttttttttgtaatttttagttgtaagttgctttaattttgcccaccatcctccattcaccttatgaatggtcccagtggtcaaccaggaacttaccttgagtttatgcactgaattaagggttcctttttcctggtctctcctttctgtctttgactctttgggagccattgttaccccagagcgccgtcacctgttttttttgtttgtttgtttgtttttgtttttttgatgagaagtcatttttaacctatctccactgcagcagcagctatcttaaggataaatcaccaataaaatagggattttacgctatgctgccccaagttttgattcccctttagaaactccctgcttgcttcatcctccaaagccctcagctagttgtgtttttgattttatccagcatttagttatttgtgtaaggattgtttttttaagagcttactcttcaatttcaaacacccaaacttcctgttcaataatttttgaaaacctaagatgataatgtaataactttctctcagatgaataagtattttaatagattttctaaaatccagtaaaacatactttggaaaaggacaataaaagtttttcttaaaatttttatttacatatcaacttaattaaacgtgttagctgatttccatgtatatatggaagatcagagaactaaattcttcaggtaatctatttttgcacatctttgggaaaaagatttctgtttgattgcctctaaagcgtagctcattcacatttaattatcttaagaataggccacttgtaacattaatccacaaagctgaatttataatttgtaagagatggcacctttgaagttgacatttcttttatatcaatgagattgcagctgcagatgaagtgcaaatggcaaattatgcaaaataaaataatcacgaggggaaacttcagttgaatatttctgtttgattaataatctatcagcagataccatctaatttaaatttgcacaaaagcataactgctgttgaaaaattgctgctgtttaacggggacacaaattcacatttctttccctcctcctctttgtgtagccaacgattgcagttacttggttttgaattgggctttttagagttaatgccttgaaaatagaaaaataataaaaagctttccttcatcctatttatgcctattcacctgcttatcatcttcaagtcttttctaggtcctatgagactagaatcattattcagttttgcccagttacctacttcttaaaagagaaatgtcattcagattctttaaactatagcggatagtcattgttctggtttgtcaaagaccaccttaaagtggtgactagaattgaaaagagaatttatttaagtaagcgtgatgaatctaacttttctcattatctggactataaaatgtcattaaggtttcctaagattcaattaggtttctttgttttttaaggggttggtttctttatgcgttttgtttctgtagcaaccctatcactcttgtaacagcacaacacaaacaccagttacccaaatataaaaacataattaaaagctatgcctttttcacatcagataatgccaagtctgggatatattacctgattctgtaacgtagataaataccttaaatgcattgttattaaaattgaccacagtgataaaatttgaccacttgacagaaattctaccctattaaagactaatctttagagagaaaagaaaaaaaatattacttgggttaatgagcttggatgtggatttagaaggtctaattcccaactagttgaataacaataattgtatcactttctttttttaaatggagacggagtctttctctgttgccggctggagtgcagtggcacgacctcagctcactgcaatctccgcctcccgggttcaagcgattcccctgcctcagcctcccaggtagctggtattgcaggtacgcacaaccatgcctggctattttttttttttttttgtactttaatagagacggggtttcaccatattagccaagatggtctcaatcttctgaccttgtgatccgcctgccttggcctcccaaagtgctgggattacaggtgtgagccaccgcgcccggccaattgtgtaactttcaacaactcatttgacctctaaaatttctgtttctttaattgtaaaactagatttttaaattaaatcacctgtatcttctcttttattctaaaaatggacattttcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctcgaacacatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgaggaaaaaaatacacctgtttgcaaggtgacatttctttgagggctcactcatggcacagcctggggatacacagaccacgggccaacatctgtggggaactcagagctttgctaattgcattcatcatattttctggggattcacttagtgctctgaaaaagccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaaggatctgtgaattgtgacttggaacaggtgggcgcacacccaccccccgccccgccacccccccaaaaagaaacaaaacccaactctagtcttcatgacagtggcagtgaccaggaaaataggacagatctgttttctcagctttctctgcactccccagtgtctagagaggaaggtaagcaagggtgtaagctcaggccctggtgtaacgtttgggcataacagagctgggctggaacttggcctctccactactgtgtgttttcgttgttgttgtttttttttgttttttttttttttggatttcttgacagctctaaccacgtaaacctaatagcagagaaaaggagtaagtgtcagccctgccatgtacaacgctgacatattttaaaagcaaacctttgttcaaaataaatcttaaccattttagagcactgctatttcttcactggaatttggatcagagaacaaatccagtccactgacaagatgtgagagaaacacaagagtttctttattctgtaagataaaatatttatgagatgatttttatcagaaggcacttattatgtagcaatctttacagactctatgcttgctgcagagttatctatgcaaaatttaaactaaaggaaacctaggtgtttacatcttaagaaagacatacatttcaaccaacagaacatgtgttatagagttgtgttttataaaggtagagtggtaaacataccttaggctaaaggaagaaaaatgatagggatatgctgcaagctgaataaacctcccttctagctgtttttttttttttttttttttttttttaagatggtagcttttgagacagtgctatctttcaggatattcagattccctttcaaacaaatgaatattctgtgccctgattgcatgttttgttaagttgggtgatgacagtggattcttagggttgtcctcctgagagagtagccccaactctattttcggagtttttctattctctagtctttgtatatgccacagacatttggtctctgagtcctcagtcttataacaatagatcttaagctttgttatctaaaaaactatccagcttctgatttaaaaccaagctgcctaactgtaattctcatatctgttatttcttctaagatctcagaggaatgctctcaacctggactattttagctcattcaatagaacataacagcagtctctgagcctgagctggttagccaccatagttctgttctgtcagggtaattgctatcatgattcacaactagtgtctcttttcttcaagaaactgtcactcagatttaccctaccttcttcacctaaatccaattctttagatcataacctaaatctaagcctttttcatttcacaaccctacatctgcaaggttcttttaattattctctgactgtctttcagttttctaacatcgacagtatagccttgcatacttttcatgaggtcatttgctttttgaaaacataagtagccacctccttcttaccatactgcaaaaactcctgtgtaagactgtttaggtcatttaaagtctgcacatctccaatttcttctcttgtacttaccacaagaatttaagaaaacattaattaccgaatgatttatgatattttcagttgcattttactctaatttgatatatctttataagccattgctaatttgttataacttactgcataaagagagtttgatagagggtttcatgatctctcaacaaaatacgaagataggtagatgatagtaaagttacagagaaaacaatctccaatattcacctgctctataggactaggtcatggaatacctttacaaaataaagaaatttggagattgtcttttttggcaaataatgattaacatgcatttttttggatagaatcaatttttgggatgtcacaagggttatataatttaatgctgataagaaacataatagtatcactgtttctctcattttgaaaatgagaagactgtgagctagagagaatacatatatcataatttttctaagatgaacaaaaagatcaaaattttaaactcttatcaccccaggctatctctgtaaatgatctttttaatttattacctgcttttggtatatatttccccagttttgtatgatttgcagctttttaaaatattctgattctttccattctaagcaaagaagaagtgcatttttctccagaatgtaagggaagtactcggcatttgatcttaatttcgctttttttacagtgtagaatgaactacagataagaggggtggaaagaaagaaaagggagagaaagccaacatgagcaaatttctattaattgtcagatcatgacacattccagccaagaatgttcctatcttcttatcaacaaaagtaaaatttactctctctctctcttttttttctcttgtaaaaatagaaacttctgacttgccttttaagctcaaaatcaaacatttctggagcacctagtatgtgagaggatcattttctctatcaaacatcttcccaacaatattatgaatgcaaagtattatgcagaattgtcaaataaactttaacaagttatgtatctgatccagattcacaaagaaatccaaactccaagttatcatgacttcaaacttctatgcctttgatattttatgtatcactagatgatattgtgtctttcaaattcctaatgtagaattgttggtaaaatgaagctctctagccaaatttaaattgacctacgagttaataaaaatgtgctaatttctaatgcaaaatcttatttagcatttttaataactaaaacattcctattgatatttgctcacaaaattattttattgtctaaaaataaattgctcagtaatgtttgtttttaagcattgataataatttgaggtggagtcttaattcttgagagaaaaacctgttcttaaaatcctgcagggcaaactcaagcattagacctttatttctcaatatgttctttcgctttttttaaatgaaattgccaaaaaaagaatagattcaaatttaaactaaaagtctagaagctaaaaccaagctaaacaaaataacactacattaaaaatataagtagatgaaaatgtgctatattttcttgtccacttcatcctgtgtaacttgtcactgagcacccattaatttcttttaaattgtttccttcactttcctcttgagagctggagtgttgaatctagcagcagatcacagctacttataaacacttggctgaaggactctcaaattctctgcaagattttgagtaaagtgaacctaggaattctgaagggacaccctttagtcagtaaggaaagagcgttcatctattccttagacttgttgctgctatcacagaagtcaaagttaaaaacacagggtatgaataccagtactaatttcctggactgattatcaaggagctgtcctctttcatggtcagaggctaatataagcactcctacaacaaaagcaggaagctttgtttctattttcttacccataacaatctttgtcctttattgatatgggagataaaaagtggtgacaatatcagacaaaaggaaagaaaagaatgcgagctttcatttttcctctcctgccttgatgagaagcagtcaaatgcaaccaaatgcccttggccatgtgaggttgggatagctcttaattagtctgcaactccaaactatcaaaaggtagggaaggcaaggatcctaggaagaaaaaccaaatactcacagacaattaaaaactaaagcctaatagttgattaatgaaatgatgtcagcctgcatgaagtgcccttatgactttgtacgaatcccttacgctgtcttaataacttggatactgatgtcaaagaaggtgtgcttatcatttttggcaaaggcataactatgagagacagagttaatatatttgaaaaaataatgcaaatttaattcaaacatttaataataatataagaaattagatgttttctcacaagataaatttaacatagatagggataaaagcccacatttagtaaaagggaacatatgaaagcacacatatttacacagatatatagggagagatgctacttaacaactgtttatgtacaaaaaatacatgagcgttttagttatttttagcacaacacgagtcaatagcattatgtggctactgaaagcattctcctataatttcagttagcacttttagaaattgtgctaaagtaaaacaagaaaattgttctattgcattctttgtcatatcctttagcatttattataactcagtatcattaattcattttttacttatttaatgtgaatctgttccattagattgtatgcttcatatcacacttgttttattcactaatccttgttcaacctatgcctactacagtacatggtccaagatgtatgtccttggtgtcttatatatagtatatgaggaaaatttggtggggtaatgtaaaggaagtagacgcctgggtggaaacgacatacattatatcccaggaaacaggcccagaatcaatatgtagaaaccagagaatgattaacttaaagtcttaaagattaattttagaatacttagaatatcatatgttgtaactattctaaagtttataagtagtccaaaatggagtagactagacttctgtttaaacatggtggaataataatacttttctttctatggcctaagagacaccaagtcagctgagggcacaagcactaacaaaacaggaagacagtgatgattaaatccttattctggctgggcgcaatggctcctgcctgtaatctgagcactttgagaggcagaggcgggcagatcacttgaggtcaggagtttaagagcagtctggccaacatggtaaaaccccatctctactaaaaatacaaaaatattagacaggcatggtggtgtgggcctataatcccagctattcaggaggcggaggcgtgagaattgcttgtatctgggaagcagaagctgtagtgagccaagattgcattgctatactccaccctgggcaacagaacaagacaccgtctcaaacaacaacaataataacaataacaacaaaaaacagacaaaaaaaataccctgcctgccaaacgtactctgtcatgaagaaaattggaaggcttttatccaaaagtgggacaaaccaagagaaaagatgcgacattgccatgtagttgttccaaataaaatggggacaattatttggaacaactaatgttgttctggtcactctacagcaaggatcatcattcctcaaactatgtgataagaagttccaacaagcctttagcatctctttcttaaatattaatggatattcagtgatgatcagatatgtgagcagagcttctaacatgaaaggaacaatagtaagaaaactaaagaaatagaacatgaaagtggggagtataagaagaaaaatattaatatccaaaatgaaattttaaaaattcttttgttaatgacaagatgatatcaaaaggaacatagaatccatataaattatgttagacaaagttgaagacattgaaaaagaacaagaaaacttaggcatataatataaaaggagaaatataaaacaaataaaagatcaattcataaagatcaagacaaattccaggaagaaagaaccgagaaaatgggaaagaaacaatctatgaacaatagatggagaaaaagaaaatgatttctgctagggcacatcattatgaaattcccaaatgtagaaaataaactattccaaagaagaaacagcagatttgaaaacagaggatggaatctcagaaagggtcttcataatggcagtattagacattagaagacattaaataagcatcttcaaaatactgaggcaaaataattagcaagctagtgatccatatctggccagcagagcttattagaatgaagacatcttcagacacacaagatctcaaaacaataactttctcaggaaactactagacaatatgttgcgggaaaaaaaaggatgaaaatcacaaagaaagttgatatgagattgatgtctaggaatcagaggatccatcacaggagagatgaaaaaagagtcatcaggaagatagtgaagggatattccaggattccattttttagcagtcccagagagtaactaacccagataaaaagaagagaatcgtaagctctcacagtgaagtgttcaagctaaaaataagtgtaaataaataaataaatacctctcttctcccccaccaaaaacaaaaaaaacaaaaaaaccctgctaaaataccagaccctactgtgacatttccattctactagtagagtttggggataaattcgttgtcattacagagaatagtaagaaaaaatttcaggaagaatgagtcattaaccttagtgaaaccaatattgtatcaagtaaaacaatgtaattaatggctcagctgtgaataatatttataaggtcatgaatagtgaaacgactgaaaactgattaattttaaaaactgaaatatgccatattgaatggttggaatgaatagttaagagctacaccatcatttccattaatcagaaattaatacagaatatctaaaattacaaaatcaagaaatgatgtacaacagttatcaattgcagaatattcaaacgttttgtagcttaaaacattaagtatttattatcttacatagtttctgtggtcaaaaacatggtactggcttcagtgtgtgaactgagtctctcataaggttaaggttaggatgccagccaagcctgcagtcagtaaggcttgactggtactcaaggatctgtttacaaagtgactcagtcacatggatggcaagcacatactactgttggcatgaggcctcagttcccctcacccccccatggacctcacctgcataagactcaagatatggcggctgcatttccccagagtaaatgattcaagaaagggcctgtaatagggaaatgtcttctatgactagtcttagagggtacaagttgttatattcacagtatactattagttactgagatcaaccctattcatcatgggagaggacttcatgtgggtaacttaccatggggaacagaggatgatatgggccagcttgaaggctatgtaccacaagcagtatgagtgtgtgtgtgtgtgtgtgtgtgttttcaacatgaagtgaagtttaaaacgatttgcattacaaacataaaagagctacatgggcagagatcctagtacttttaaaagaactgttttataattatccatgtgaatgaaactacaggtctgggaccttcttttcctgaaatgcttgtatatattgggcagcttaatttgtttactttgttattattgtaagagatcttgagtaacctgacaataagctatatgtgctctttaaattctatatatctgctctccagtaccactaccttggtgcaggcagaagtgagtacttggaattggctttttgtattattattttgaaaagaaagaagaagaaaatcagtaaacaatagtgtcctaaatgaatatctttagaaataacccttcttagtagaccattgatattcttcggcatttcaggaaattaatccacccacttgataatggttgaaaattggtatcttaagacacagttgtttctcccaacatatcgatattatatcagactgatgtatcttgcattctcccagtaaaaaggaaatagaattttaataaaagccagattgtgcaactaatactctggaattgtagtgcattttttaaaatcttcatgcaggaaatgaaagagaaaaaaagaatccagatcctaacttttcagtagaagagtgaaatgtaaaatgattttagaaaatagattattttcaaatttgtattcttcacttttgaagaagagcgtattttcctcctggatacataatttggaaacatatttcaaaaaccgaatcttaatctatgcaatgaacatatcaaaaagtaaattactatcttcaagggaatgaaatatcatattagagaagcacactctagcaccacagtaattatggctttgccaacatttctgtgcaaagtctgattctgaaacagttttttcttaccccacacagccttgtttatgtaagaatttagtgtttaccccaaccttcaaatacaagttgacctattgttttacttctttaagtgaaactttttgggactatatgactttctaacttcctccagaaatatgtatggttctggatttcctccgtgcttcatctactgtagcttacagaagagaatgttatagaattattgcattttagaatcgaactttgaagcatgttactgaagccatatcatgatgggggagcagtccagaaatatttttaaagcactagtcttggagtcagaagctctgtgttagcctacctacttattagtagggttgccttgatgaagtcacttgattttctgaaatatttctctctctctctctcaaaaatctgtaaaatggaagcaacaaactcaatggcttttaagatctttgtaacctccagtgttactcaagtttgaatagagagagaaggtgagaaacaaatctagaatacacatctcctaactcccagtttggcatattcacaaatgttagatttatgatgattagtgagaaaatataactattccaaatacatttctaggtatgtgagatatattacaatatggaaggaaaatgataccaaattgtggctcttctctatggccctcatcagggaactattctgaaataataggacatgtgtctaaccaaatccatatttttatatgctcatcagcttctaactatgtacttgacttgatctattcttaatgtcaccaaattaacatcttgaggaagcatgaaattttccaaaaagaatctatgagcatttggtggctatttgccagaaatatttctcctggacaaaagatggaaagccattctggaaagcaagagtgttttattagaatacagcagtgctttagtttaatgtgatcattacccttgtaagtttctaatcaactatttgcaggatggttttacaaatatggtttgactaacctcaagccttattttttgcatgcgaaatctactaaaaaatgcaacattatcattattgcatttacatatttcttccacatgtataacaaagtagaatgtatctccctcgttcttaccaaaaacctctaatatagtgacgtgttctgccaaaatgtaataaatgagaaagcatatgctttgcaggcagacatactgggtatttggaatctcatttctgcacttcttagctattatgttcctgggcaagatatttaatgtctctgagcctcagttccttcctctgtgaaatgagactaataatactgctctcataaagctgtattaatatatattctaactatatatgtgaaattacataaaattatgaaatagagagagtggtatatttagctccgttagatgcattaaaatgctaaacatctgtatcttttttttttttaaccagttttctttcaatcacgataaagtcatgacaactggtaactttaggaataatcttaccactaggcagggttgataaatcaattgtataaaatggtacataaatcaaagcctatgtttctctttttaatgtgtgtagccacaactactacatgaccttcatgctttactgctgagagaatacatatttagacaaaagctcaaggagttgcattctactacataacatgcagtggtttgtttctgtgactcgctgtggaagtgatttctaggagcgccagatgcttggatgctatttttatatagatagaaagggaatcccttcatttattggatgttcttggcatggtattgtgtgatttggtgcttgaccaggtgggagtctcttatttatgaagttcagaaaattccagtgcttagccaagtctctactgaatgcccaggatatacttgaaggttaacagtggcataaagtattagtgtttcctgatttttatatgtggatagaatatcttttggctcttggtttatacagattcttgcattattctctcatgagctcagttcttggccttaatgcccttgagttctttagggctacttcctccagcctttttgtctgacatcactactgcctctccacgatgtaaaatctgcactgtgattcaaagagatcccctgcatatagcagagtcattcttccaatggtttcctctttctttttcatttcaattcccacaagcctccatcttcagcaagtctgttgctgacaggttgaacaaatactgctaagatatatttattctctgagaccctttttcacttagagtaaatatgttactgtctcagttcatgttccagcaaaacgcagactctaaggtatggatttcagtacaaagagattacttggcaggtgatcttaagaaataccaatgagaaagtgggataaggaagaaaaggtacaataaaggatcctttgggaagcctgctagcactgtgggcaactgagattgaatcctttggggagcactggagaatacttaactgagagtgactcccatgcctctccacaggagggaaaatagtatactcagtccctgatttaaagctgatcccaaaggcattaattaccaataattctgtagactgctgatggagagatccaaaaaagctttggggcagagcaacacagctgttcagctggaattcagggcatgcactgaaatggtaagagacaatgggataggagcagataaccaaagtgtctaccataatcacctttaaaacatgctttatgcaattatagaattggaaattattttagagaccagctctcagcttatgagtcacaacaaggttattgataatatcgtaggtgggataattctttattgggcagagttagctccgtacattgcaggatctaccactaagcaccagtcagacacccagttattttgactgcacaaataaccatttatattttcaagtgcccctctgttggtcaacattttctctgagcaccacagttttataggggaaggaattttttttgtttttggtttttgggactgagtctcactttcttgcccaggctggagtgcaatggcgccatctcagctcactgcaacttccgcctcctgggttcaagcaactctcctgcctcagcctcccgagtagctggtattataggcatacgccaccacaccagctaatttttgtatttttagtagaaacgggttttcgttatgttggccaggctggtctgaaactcctgacctcaggtgatcctcccacctcggccaggcgtaagcaaccgtgccaggctagggggaggaattctaacttggcaaggctaagagacctgctaaaaggcaattggcaaccagtgtccacgtctccagaattatcatagagagaaaacagaaaccttctttttgagggagatcatctctgagatatttttacctgggtagcagtgaatcctggatacacagaaatataatataatatttgagtgaaataagtattaaattattatgggagctaaacaaattgccctcaattccctatctgtgcatttttatctgcttttaaataatataaattattattacctatgtccacatgcagaggcagaggaaaagagaatccctttaaaatgattacaagccaacaaaatatttgcaagtgaaaacatatattttgggggaactgccttgttattttaagtttacattatacctactttaattccagaatgtcattacagaggaaaaaaaaaagcttgattagctgagtaacatcacttttttaaccaatgcactctcctactgcttagttccttacagctggataagtgggtaacctttgtgtccatagattcttaggtagatggaatctattgggaaaggaaatcaattttacacatatacatacacatatttttaaatttcagactgtttttatctaaaatagaagcacggattttgagtccccccaaaatggatattatttgtctcattcgatggacttactataaattctagaatggcgggatgttatgaacggcatcgcacatgctacacaaacacaaattctgctcttacgattacaccattacaagataaatgtattctcaagtagctgcagtattctattaaaatgtagacacaagcagaatcatttttattaagaaaaaaagcagagcaaagcatttaaaatataaataaaatataaaaacaattgctttcctattaaatacaaaactagagagcactgtttcaaattggtaagtcatatctgtttaatatgattgcaattatttatggggattaggaaaattaatgtcaaatctaatattttcgaaaaatggaagactcaattaattaaccagacatttcatcctggaatcctatttctttttctttccagagggaacctaaatggagattatattagagaattaagtttgacagttaatttatgaagaactaatattataagtatcaattaaatagaggtgagggatatatggaattagtttgagttgttaaactgaccatttcaaaaattagaagtattttatcactaatacagatttgagaaattattagcaattctaaattattcagatttgcttaaattcaatgattatgatttagatgaattaagaaagttactcagtttgtttaaactgtggaagttaactttagtgtcccaaacctgggacattagcttcattttatttcggctatgccaggatatatttgaagctcgtattctgtacaacagtgtatactattgtagagaatggggatggataataataataaaatatcactttgtcagtaaataaatattcactgaatgataattgtgtgctaaggaatttatatgtatattatctcattcaattctcataaaatctgtgtgatagggcccagtatagttttctgttttccaattgaggtaactgggtcacagagaatgaagcctcgcaaccatggttatgccgctactatgtaaggaatttgctttaatcccccagtatccctactctaatctaagtcagaatctagacatgcagatcaatacaaatacatttcagcctaaaaaaaaaaaactctgaaagcacatttccaattttgccagcagttagttattcatctacagaagctattagtcccagtttgtaacattagcaaaaattaattttcagtctttttcttatagtttgtcttggtagcttttgacaaagttggccataacctctctctggataggtgacaaggtgcagtagtgcaccttgtctttcagaacagcaatactcttctggttgacctcttattcctttgacagtgacttctctgattcctttagaggtgtctcttttaatttctaaaaaatgctgatggttttaatgtgttatttttatgacacatatcccccttgggaaattgctcttgttcaaccaccgtctcatgctactgactgcagtgtagactgctctatgttcaatcatctactggaaaccaccgttgaaagcttgaggtgcataacttagacttatattttctcaaacctgctctcatactcacttaccctcactagaagtcctctttactcctccctcttttttacatgtccccatgttaaatttcattattcagtcttgattcattgattaattatttataatttataattttatattttagaatttttttcaggtgctggggatacaattatagacatgattaagtactagtttcatgaggcttatacagtagttacccccttaaccatggagggtacattccaagacccccagtaatgcttaaaaccatggatagtaccaaaccctgtatgtatgtatgggtatatatatattttttatatatatatatatatacacacatagcatatatgtatatgctatgaatacatgtatacatatatgctatgaaaacatgtatacatatatatttatgcataacacgaatgaagaatgcataacaagaatggagcaatgcatttaaaatataaataaaatataaaaacattactttcatattaaatacatatatgtatgcataacaatattttggtaaactatagactacataaagacagtagccctataagattataataagatatttttactatatcttttctatgtttagatatgtttagatacacaaatatttaccattttgttacaattgattacagcttttaggacattaacatactgtcctaggagcctaggatcaataggctatactacatagcctaggtgtgtaggaggctagaccacctaggtttgtgtaagtacactctatgatgtttgcaaaacaaaatcacctgaaaactaacttctcagaatgtacccccatcattaagtaatgcatgactgtgctgttttttcctttatgtccatacctatgataaaatttaagatataaattacacacagtaggaaattaatcacaataactaataataaaatagaactattgtaacaatatactgtaataaaagccatgtcattgtggtctctctctctaattttattgtactttactcacccttcttcagatgacatgaaattacaagacacctatgtgataagatgaagtgaggtgaatgctttgggcattgtgacataacatttaaaacttgaattatttctggacttttccatttaatattaagctgctgttgaccttaggtaactgaaactgcggaaagcaaaaccaaggataaggatggtctcctgatgagttagggttgagaaaacaaatctgtaaagaaacaaataatatgctttctactagggatgagtgttttgaaaaaacataaaacagatgagtaaataaagagtgaaaaggcatagcattttatctaaaatatacattgagtgcaatgtgtcagttgagtgaactatcttggttgcaaaagtcattaaggctcttaggagtcgtgaaagccttctgtgagaaggtgattttggtcacagtaatgaatgatgaaatggtggaattaatgaagagttggtgaaagagacaaataagaaggaaagcaagtttaaaggttctgaggagtgaacaatttggcacttcccatggtttcatttaactgtaagatttgcttccgaaaatatttctgtctttggtatcacttgtcttactaggtactgtaggctttgggctttttctaaatccagtattcactaagcagtcagagtttctggtttatctacacatacaaatccgtttatatgatttcagtgcttatacctttctagatttccatgtacaactgtgcactgcaaaacactaaggaatagcattcacttagactaggatgtaagcattactccatggagttgtgtgacatgctggccctaaattccgtgccatcgatagcgggaggaagtagaaatcctttgacaattattttcctcttgatctaggatacaccctttgctggagtctgatttcttataattttctactactacatgctacattgtggtagtttatggttctgttaccctaattcccttcctcctccctgtagtgacttccttttctggttaacacgttttcattctttgaacttcagctcagataaaacatatgtggagcagacttgccaagtctagattaaatacctgtggtgcaacactgccaaattgagagacatttgtctctcaatttttcatatcatttgtagtttttttttttttaagacagtctagctctgtcccccaggctggagtgcagtagcgtgatctcggctcactgcctcagcctccccagtagctgggactacaggtgcgtgccaccacgtctggctaattttgtatttttggtagagatgggatttcaccatgttagccaggatagtcttgatctcctgacctcatgatccgcccgcgtcggcatcccaaagtgctgggattacagacgtgagccatcgtgcctggccccgtttgtagttctaaaattcaagtctggatatattagttccccgcttaaaatgcctcatgtcttcccactttctataataaaaagtctactatccttcgcatgacattgcctttattttaaatctccttacaattctcgcatctttttcttgagagtcccattgtcaagtatacacttacggtttcctgactaggccaagtggttcccagcatagctctgtgtaaccctctggaattctacagtcacctgtccatctccaaaggctcagtcaagtgtcacatacactgtcaggttttttctgacccaggcatagaactgcccttctcagtgtctctgcttttctctgtgtggacttctatcacaacacctattatcatttactgagtttagtcgtttgtttttctgtcttcttttgtaaactcatggaggatgagactttatttctgaacagtggagacagctggcacctgagagttgcttatttgagtagatgaacgagtgatttaaaaaatttgggaaggatattgaaatgaacctaattgtggtaatcatattcttaataaatacaaactgagacaaaagatttattctgtgaattttgttttgccctcaaaataaagtagtatctcatttcatacgtagtatgttggaatgttttgccatggctgctatactgattggcattgctcactgctgttcgttgcaatatacaccagctgtttttcagcagaatgagtggtacaccttaaaagccaagtctttctccccgaacagagcgctgggccaggctcaaatctgtcatctaatcactcactgtgtgctgaacactagtctgactttccacgtgatctttctacactttttacacacacgcccacacattatttatgctcaaaagaatgatctgttatgagagtacagtgaatgtgttagtttcaagagataagattgtccagattcagaaacttgtagctgtcatcttctagtttcctcactgcaagtgtggagtaagattggtataacattagttcatcattcttttcagattagaaaatcttacatggtcatctgggagaacagggcaaaacaaaggtcaaatgttatggctagaaatcaagcctgcaaagcaccatcaatggaaaatttgtcatattttatggagaaactataattcttacaaatctctactaacagttctggttgtgttgatgctttggactgtctagagagtcacactcttctgtccattaacttaaaagcatgactttttagtatgttcatttccccatatggggtacaagattagtaatatcgtcttttaccaggtactttctctatgatcatggacatttgcctattctaatcagatccctgcatagttatttaggtaacttccttgaagaatatagtactaaggcagaatgaccatataatttattattgaagttagataactttttgagagcgaagaaagcagtacccatagttaccccaggatgacaggcataaattgaaatacgtggtcaacgtagtatatgggagacatgacttttaggagaaaatatttccaaataactcaaatcttaaaaacctccagagacttcaaacccattctgaaaacataatttgctgttcatatctcaaaataacatggttatcacctggggatagaaagatcatgacaacactgatgtgtgccatgaaattctttccatacttacatgaggttgtcaggtccaaactccaaatgcagaaaaacatgcagagaattgtagttcttgagcatctcttcttgaattagagcataacaattaacttttaaatcatttttggatactattgccaatgctttttattttgggtatctttttaacttaagtgctagctttcagaagtggaaagaaggataaatactgtaattatccttctattataaaatattacatttttaattacagcaattatttctagctacaaatctttaaatgtatgatgttttacttatgtttgataataaataggcaatactttgtgatacacagttgacacaagacaaatctaaataaaaaatgagaacatgagcccccttaattttatggattgttttttaaactgactttgcttctatgcaggcctttcactttctgtaaacacttaagggatattttttaatactctgtaaagtaaatttcagaatggaaaacataactccgaggtgtattttcaatccgcacaattttttttcacagaggtgtagaaaacattctacctgttattaaaaaaaattctatgtatttttggtttgtttgtttgtttgtttgagagggagtttcgctcttcgtgcccaggctggagggcaatgttgcgatctcggctcactgcaacctccgcctcccaggttcaagcaattctcccctcagattcccaagtagctgggattacaggtgcctgccaccacgcctggctaatttttgtatttttggtaaagacaaggtttctgcatgttggccaggctggtctcaaactcctgacctcaggtggtccgcctgtctcagcctcctaaagtgctgggattacaggcatgagccaccacgcccagccacaaattctgtgtttttaatagctttattgagatataatttacctgctataaagttactcatttgaagtataaaatttaatagttttagtccatttatagagttgtgcatcatcgtcctaatcttgttatagaacattttaaccatcttctccccaaaaaaccttgatcacattagcaatctctccccattccctctgctgtccacccctcatgcagcccccagccatagacaagaactcatcaactctctgtctctatatatttgcctctttggaacatttcacaaaaaatggtattatacaatatattgtcttttatatctggcttccttcatttagtatgtttttgagattcataggtgttgtagcatctatcagtgcttcatttctttcactgtctaatagtgttccatttcttggatatactacattttatttagtcattcctcagtgggatctttgggttgtttccatttttgactcttaatgctgccatccacgcaaaaggtttttcagtgtttcattttattgtcttttttttttttttttttttttaacgtatgttttcttttctcttgggtagaattccacctaggagtacagttgctgagtcatatggtaactctctgtttaaccttttgaaaaattgccaaactattttcaaaatttgctgtaccatttcacattcccatcagcaatatctgaggatcccaatttctcttcatactttctaatacttctacatcttttttaatataggcatttcagtggatccctaatgataataggcacttctgattgtttttgtaaataaaatgttattagaacacagccacccccattcgtttattctttttttttttttttttgttttttgttttttgagatggagtctcgctctgtcgcccaggctggagtgcagtggctctatctctgctcactgcaagctctgcctcccgggttcatgccattctcctgcctcagcctcccatgtagctgggactacaggcgcccgcccccacgcctgactaacttggttttgtatttttagtagagacgggctttcaccgtgttagccaggatggtctcgatctcctgacctcgtgatccgcccgcctcggcctcccaaagtgctgggattacaggcgtgagccaccgtgcccggctccattcatttattcttattgtctatgggtatttttgtggtatgatggcagagttgaaccacagagacaacatggctcacaaatcctaaaatatttattttctgaccctttacagaaaaagttcaccagcctctgctttagcgaatcaaaaatttacgtcctcaatcatgttttatttacaagtgattggcgtatgtcaggatgtttagtgagcgatacaggagtatttcattgtatttggagggaatgattgaaatgattttatacagataatcttctgaatttgtgattggtgttatatttcaatttatcaatttattcatatttatttaacaagttattacatatatatttattcggtatagttgtgaaagtcttattatatgccagtggctgtgttagaatttaaggataatgcagtgaggagcaacaagacccctgctttaacagagcttacaatttatggaaagactgcctcttactctgaggaaggtgggagtcatccagtctacagtggagctgagggcctgagggaaagaactgttagaacagatcactggtacaagatctgtagttctgaggaggagactctcctctttgtataatttctcagagcctttaccgtatgaaatatgcattgcatatctctagcaagatttccaaggtacctgagcaccagatctcttagtttgatgaagtatttagggctccacgaaacattttctgaaaaaaaaattacatagaacattgttggtcaagaattgtcagatgaaaagattcttaaaagaccctagaaacaaaacgagatcatttactcaacatctttctttttctagtgctacgtgaccttttaatcttgaaatttttcttgtgtagatgttaggcctgtaaattagttatggtaatgtcaattcaaagcgtctttgaagtttagtttgtcctttattggattcctgtctttcatatttgtctttctaaagcactttaaaatcttggagaagaaagttcaaggaaagatgatataatagattattcttccttgggctgcaatacttttaaaaggattattccttatctttttgttaaattgacttctataaatttttcaaagtgaagtgttttggttctcaaaggctaggagtatccttttatcttctttttctattctctcatattttccttccttgacaaattcatggctgaataacagtatcgaaatgttatcataattctttggctaattatttttgtcaagccccccaaaaggcaaaaacaagcactgtttaaaatgtttagtttggcagcatgagataaattagaagtgcagagaatgagcaacctatgagatcatctgtctgctgctacgtgcagcccatcacaattctagactgttagaaactcaagctcaattacccactttgctattcagttcctgcatactttgcgtgaataactgccccactctgtaactcagattcctcagctgtataatcaatggagttaataatacttatttcagttattgtgaagcaccgagtagatggttggcatgcaataaatatagttaccaacctataacattggtctaaggaatgaagaaacatctgttagaaagacagctttttaaatgaaaatactaatagtgccctgaagaaagatttatctttcttagtatgtcacagttaccagatggaaaaatcagcaaaatacaaaacacttaatgaatataggtatcatgatatcattatgatcataaggaaaaaagtggaacagttagatggggttataactggtaaatccatacttgaacgagatgtctaacatttagagtggagttcccctgggtttattaaaggttagtgttctctatcttccccagggagaattttataaatatataaataacgatatgaattacctctttggataaatatataaatgctatttaataaaaaaaaaatgtgtctgacctaaagctggaagggattgataatacgttgaatagcagaatgatgaccataccatatggataggtgatgtggtaaacctaatttgtgagctaattttttttgaagaaatgtgagaaagatcttttttggattcacaatattatcttcacaaatctttgaaagggaaaatgtaagtgtggaaaagacttcagtatttaaaattactgtaattgcaaaataagagttatagtgtgctaaggagatacttctgacaaaaacagtcccatgtaactatagccagatcaaattgatatgaagtatctgcaacagtggagattattgacctattcagttttagacttcattatgacagtgttagtttcagtggagctactccattctgagggacaaagataaacgttaaggtattcaagaaaagttaaatagttgtgggcagttgttgataaaaggattaagacattaagaatagccatgtagtttggaaaatcaactacaaaaaattatatctggaaatatctttccaaaactagctttgacatttttgtttctacaactccatgtttaggcatgtaacatgaaggaatctctcctcacgtaaaagaaatgcctagggttttaaattccagcatagttgtataatattgaaaactacctaaggtgctcattgaataatttatgtataaccactgagtagaatagtatttggccataaaaaagaatgaagaaagttttctctgaactgatataaagtgattaagaagatatatgttgtaaagtataattacagtattttaacttttgtttcacaaataaggaaaaataagaatgtatgatattttttctctctcttgagatatctctatatctgtttgtctatttgtctgaatctgtctgtctgcttgggtatactttcctggccaaaaagaaaaaaaaaaacaaaaaacagaagtataaacagaaactaaaaaatagttacctctgtagagtaggtgaaaatgggatagagggaataagaatcggaatgtaagttccttgaaagcaagaaacttgctttatatagtaaactctttatgtagttgacgttttaattataaaaatatcctatatatttaaacaaacaaaattaaaaggatgaaaaaatcagttgaatcaatcagacatacatgatcttaaccaaatatcaaattatttactaccatactgagaaaataataatttaagtaacttttacttgattaattaatttgtcaattaacgtactaattcatcaacaaattaagattataaattcaggtaacattattcctaaaaaactccatcttaaattcatctgacttttctatatttcaatattaccatttccccatgatttatacatgcttagaaagataaattctaaagtccaatacaactgcaaaaatatcattagctcttgttttttattatagttgtattggtgtggtcattctcacattgttttctgtatatattgtatgaaagaattagtgagtaaatgcattagcatggttggaagaaaggaggcacaaatatggaatgggtatgtgtggaagaatgctttagtgttggattttctttagaagtatcagtataaccctgttagacatagacacatacacatatttaatacaaacttcaagcacattttcatccatcttaaatttatctgactattctatgtttcaatattaccatttcttcttgattgaaggatgtcattatgcctgtttgtgcatataatgaacagatattgatttctaaataccactcactaaacacacattgaaaactgggaaacttaaatggctgatttcaggtctgcaacaagaaagaacaaattgggttatgccagaaagcaatggcatactcaatggttaataggataaggttgaaaaggcacagatgctctgtatagggaatttattgaccacatttggggtatgtagcttcagtaagaaaaatatagaataacatgttgaattacaaaaaaaatccaagagtacatagtaatacaagagataaaaagaaagacaaaaatggcagttcttttaaaaaagaattatgtgattttattagcccttcttcaccctattgctgatagagggattcctactctagtgttatatggatgacagaatataacacctgacactgggcagatgagatcacctgcagttcatacacattcatactcacatatggcatacatatatatactctcagctaggggaggagagcaccccatgccacagaggcccacacaggttgcacttgggaacaaagtgaataaccagggactgtggacagcaagatttatagtgtcaacagagggaaaggccccagtactcatgggaggatgtggttggtttagttatttttttattttaaaatgtaatgtaaattaattttaagttctgggatacatgtgcaggatgtgcaggtttgttacataggtaaacgtgtgctatggtggtttgctgcacctatcaacctatcacataggtattaagtcctgtaagaattagctgtttgtcttaatgctctccctcccctcaccccctcaaagggccctagtgagtgttgttcccctccctgtgtcaatatgttctcattgttcagctcccacttagaaatgagaagaggcagtgttttgttttctgttcctgtgttagtttgctgaggataatggctcccggctccatccatgtctctgcaaagacatgatctccttcctttttatggctgtataacaatccatgatgtattttctttatccagtctattattgatgggcatttgggttgatttcatatctttgctattgtgaatagtgctgcaataaacatgcacatgcatgtatcccagtaatgggattgctagtcaaatggcatttctggttctagaaatgccatttctggttctagaaatgccatttctggttctaggtctttgaagaattgccatgctgtcttccacagtggttgaactgatttacattttcaccaacagtgtaaaagcattcctatctctccacagcttcaccagctctgttctttcttaaatttttaataatcaccattctgactggcgtgagatgcttctcattgtggttctgatttacgtttctcaattgatcagtgatgttgagctttttttcatgcttcttggccatataaatgtcttcttttgagaagtgtctgttcatgtcctttgcccactttttaatggtgttgtttgttttgtttcttgtaaattaatttaagttccttgtaaattttggatattagacccttgtcagatggataaattggaaaaattttctcccattctgtaggttgtctgttcaactgatgatagtctcttttgctgtgcagaagctctttagtttaattagatcccatttgttaattttttcttttgttgtaattgttttggctgctttcatcatgaaatttttgcctatgcctatgtactgaatggcattgcctgcatattgttctaaggttttcacagttttgggctatacctttaaatctttaatctgtcttgagttaatttttgtataaggtgtaaggaggggttcagtttcaattttctacatgtggctagccagttctcccagcaccatttattttacatttatttatttatttagtttttgttttttttctaggtcaagtttttttttattattattattatactttaagttttagggtacatgtgcacaacgtgcaggtttgttacatatgtatacatgtgccatgttggtgtgctgcacccattaactcgtcatttacattaggtatatctcctaatgctatccttcccccttccccctaccccacgacaggccccagtgtgtgatgttccccaccctgtgacccagtgttctcattgttcaattcccacctatgagtgagaacatgcggtgtttggttttctgtacttgcgatagtttgctgagaatgatagtttcccgcttcatccatgtccctacagaggacacgaactcatccttttttatggctgcatagtattccatggtgtatatgtgccacattttcttaatccagtctatcattggtggacatttgggttggttccaagtctttgctattgcgaatagtgctgcaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttctttcctgactttttaatgattgccattctaactggtgtgagatggtatctcattgtggttgatttgtatttctctgatggccagtgatgataagcattttttcatgtgttttttggctgcataaatgtcttcttttgagacgtgtctgttcatatccagcaccatttattaaatagggaatcctttcctcattgcttgtttttgtcaggtttgttgaagatcaaatggttgtagatgtgtggtgttatttctgaggcctctgctctgttccattggtctatatatccgttttggtaccagtaccatgctgttttggttactgtagccttgtagtatgatttgaagtcaggtagcatgatgcctccagctttgttcttgcccagaattgtcttggctatgcgggctcttttttggttccatgtgaagtttaaagtagtttttttccaattctgtgaagaatgccaatggtagtttaatgggagggaataacatcgaatgtataaattattttgggctgtatggccattttcataatattgattatacctatcattgaacatggaatgtttttccatttgtctgtgtcctatcttatttccttgagccatggtttgtagttttccttgaagaggtccttcacctcccttgttagctgtattcctaggtattttactccttttgtagcaattgtgaatgggagttcatttatgattttgctctctgcttgtctattattagtgtataggaaagtttatgatttttgctcattgattttgtatcctgagactttggtgaagttgcttatgagcttaagaagtttttagactgagacagttggggttttctagatataggatcatgtcatctgcaaatagagacagtttgacttcctctcttcctacctgaataccctttattttttctcttgcctgattgccctggccagaacttcaaatactatgttaaatagtagttgtgaaacaggacatccttgtcttgtgctgatttgcaagaggagtgtttccagcttttgccctttcaatatgatattggctgtgggtttgtaataaatggctcttatttttttgaggtatgttccttcaatacctagtttattgagaatttttaacatgaagcgatgttgaattttatcaaaggccttttctgcatctattgagaatcatgtggtttttatatttagttctgtttatgtgatgaattacatttattgatttgcatatgttgaactagccttgtatcccagggatgaagtgacttgatcatggtggataagctttttgatatgttgctggatccagtttgccagtattttgttgaggatttttgcattgatgtttgtcaggcattgatattggcctgaaatattctttgtggtatctctgccaggttttggtatcaggatgatgctggctgcataagatgaattaaagagaagtccctctttttcaattgtttgcaatagtttcagaagaagtggcaccagctcctctttgtacttctggtagaattcagctgtaaatacatctgatcctgggcttttttttttttttttttttttttgtggtttgtaggctattaattagtgtctcaatttcagaacttgttattggactattcaaggattcaacttcttcctcgttcagtcttgggagggtgtatgtgtccagtaatttgtccatttcttatagattttatagtttatttgcataggggtatttatagcattctctgatgattgtttgtatttctttagggtctgtggtgatatcccctttatcattttttattgtgtctatatgattcttttttcttctttattagtccagctagtggtctattttattaattttttcaaaaacaaactggattcattgattttttgaagggttttttgggtccctttctccttcagttctgctctgatcttggttatttcttgtcttctgccagttttggggtttgtttactgttggttctctaattcttttagttgtgattttaggatattgatttgagctctttctagctttttgatgtggacattttagtgctacaaattttcctcttaacactgctttagctgcatcccagtgattttgatacattgtctctttgttctcattggtttcaaagaacttcttgatgtatgccttaatttcattatttacccaggagtcattcaggagcaggttgttcaattttcatgtagttgtgtgcttttgagtgagtttcttgatcctaagttctaatttgatggcactgtggtctgagagactggttgttatgatttcagttcttttgcatttgctgaggattattttacttccaattatgggatcaattttagagtaagtgccatgtagcactcagaagaatttatattctgttgttttggggtggagagttctgtaggtatctatcaggtacacttgctgcagaactgagttcaagtcccgtatatccctgttaattttcaattgtgatgatctgtcttatattgacagtggggtgttgaagtctcacactgttactatgtgggaatctaagtctctttgtaggtctctaagaacatgttttatgaatctgggttcttctgtattgggtacatatatatttctgatagctagctcttcttgttgaattgaaccctttagcattatgcaatgcccttctttgtcttttttgatctgtgttggtttaaagtctgttttgtcagaaaactaggattgcaacccttgctatattctgctttccatttgcttgttaaattttcccccatccctttcttttgtgtctttgtacgtgagatgggtttcttgaatgcagcacactgatgggtcttgactctatccagcttgccattctctgtcttttgatcagggcatttagcatgtttacatttaaggttaatattattatgtttgatttgtgtgtccttggtctttgttcttcagtgtgtttttgtaatggctgttaacgatttttcccttccatatttagcccttcctacaatagctcttacaaggcaggcatgatggtgacgaattccctcagcatttacttttctgaaaaagatgttatttctcctttgcttttgaaacttagtttggccagatgtgaaattctgggttggaaattcttttctttaagaatgggagaaaatttttacaatctacccatctgacaaagggctaatgtccagaatctataaaaaacttaaataaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacaatgttggtgggactgtaaactaattcaaccattgtggaagacagtgtggtgattcctcaaggatctagaactagaaataccatttgacccagccatcccattactgggtatatatccaaaggattataaatcatgctgctataaagacacatgcacacgtatgtttattatggcactattcacaatagcaaagacttggaaccaacccaaatgtccaccaatgatagactggattaagacaatgtggcacatatacaccatggaatactatgcagctataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaacatcacacaccagggtctgttgtggggtgggggtaagggggaaggatagcattaggagatatacctaatgtaaatgacgagttaatgggtgcagcacaccaacatggcacatgtatacatatgtaacaaacctgcacgttgtacacatgtaccctagaacttaaagtataaaaaaaaagaaaagaatgttgaatattggccctcaatctcttctggaatatagggtttctgctgagaggtccactgttagtctgacaggcttccctttataggtgacctgacctttttctctggctgcctttaacattttttccttcatttcaaccttggagaatctgatgattatgtgtcttggggttgatcttctcatggagtatcttactggggttctctggatttcctgaatttgaatgttcacctgtcttggtaggttgaaaaagttctcctggatgatatcctgacgtatgttttacaacttggtttcattctgcctgtctctttcagctacccctatcagtcataggttcagtctttttacataatctcatagttcttggaggttttgttcattccttttcattctttttttttcctaatcttctcttcctgttttatttcagcaagatagtcttcaagctctgaaattctttcctctgcttgatctcttcagttattgatacttgtatttgcattgtgaagttattgtgttgtgtttttcagctccatccggtcatttatgttcctctctaaactggttattctgtttaacagctccttctgaagactacttccgtcagtttatccatctcagcctctgcctagttctgtgctcttgctggagaggtgctgcaatcatttggaggagaagaggcactctggctttttgagttttcaacattttttcattgattctttctcatcttcaggagtttatccagctttgatcacagaagctgctgacctttggatgggtttttttgtggggacttttttgttgacgttattgttattgttgctttctgtttgtttatttttcttttaagagtcaggctcttctttcataggcgtgctgcagtttgcttggggtccactccagactctatttacctggttcctttccacacctggaagtgtcaccagtggaggctatagaacagtaaagatggctgccttttctttcctctgggatctctgtaccagaggggcactgacctgatgccaacagaaatgctactgtataatgtgtctggcaaccctaattgagggttctcctccagtcaggaggcaccggatgtgggactcactaactgaggcatgttggctgctccttggtggaggaggtgcactgtgctgggaggaatcccacttgtctagactgcccagattcctcaaagccagcaggggcaaagactaagtctactgatttgcgaagactgcggccacccctccttctaggggctcagtcccagagagattagagttctgttgctaaaaccctggctggagtttctgaaattcttgtagggagggcttgcctagggaaatggtgtgggtaaggatccagcctaaagaggcaatctggccacactctgccacagccacggtgctgcactatggggaattcctccagggtccaaaccatccattttccctggcattgcaggggaaagatggcaaactggagctgcagtgatggcggccacccctcctcccggaactcagtcatcttatgcagcaggcagccacagtgatggctgccgcccttccccttgaaagctcagccatcttaggcagcatgcagccacagtgatgatggccacccctccctctgggaactcggtagtcttaggcagtctccagccgagtagccgctgagaatctgcacaactctgcggttcagacccaaggctctggtggcgtgggctgacaagggggatctcctgatctatgggttgcacagatctgtggaaaaagtgtggtttcccaggcagagtagcaccatcactcaccgcctccctcggctgaaggtggtagctccccttgccctgtctgactcctaggtgggctgtggcaccactctgcttttccttactctccgtaggtcacaccaaccacctactcagtcccattaagaagacctggatacctcagttcagtctgtttaaataattcttcaagtttgcaggcaactgaaactcaccagttaatgattaagtagtagccgcacctgttccatttgataagaaaggttatttggagaggatcttagctctagaagcccaatggggagggaagcttgtggttaagttattggaggccctgtgatttcaccagatatccagtcagcacataattttagacattagttcttaggctttatatcatataataaatatggctggaatgatagactagaaaactcttgatgtttctgtcctaatattataatttattaatgaaagaattatcaatacattctaaaatcattgggcaaaaagtgtttaagaatagaatattcatgttttcaaagcatcattgcacatattacttgaaaggtggaacatgtccctttaaaatggaaagatcatacagtgacaatcttaaccaagtggctaagtttggcattactgatggtgtaaagcctaactttttgtttcttctgatgacatgcaatgggagattcactacaccagttttgtggtattcttaccaaaaatgttgacctcagtctaatcgcaaaaaaaaaaaaacaaaaaacagacaaatctatgatggtatgctttgcgagacagctaccctgggcttctcaaaaagttaatactttaatattaaatcaaaatatgtaataatgaataataggggaaaacatcaactattttaaattagataagactaaagtaacgtaacagtgaaatgcaatgcatgaagttgcatgacagaccgaaaagatataaagaacatttacgtgactattgatgaaatgtaacgtaggttgcatgttgtataattttattaaactgtttatttttctcaggtgtggtaatggtgttgtggttatatattcttgggaggcccatacttaaatataattgtgcaatctcctttggatcattcaacaaaacagttgtgtgtatgtttatgttaaaagagagaaggagacagagagagagaaaaggagagagacagaaaaagagagagagtgagagaaggagagaaggagaaaaagtgagagaaatgaagtatatatggaaagatgttgagaattagtgattctaagtgaggattatgcagatctttattgtactgttctttcaacttttcttcaagtttgaggtttttaaaagtaaaaaaaaaaattaccacatagctgaaggtgaaaacataccaattatggtggataaataacttaaacagggagtcagacttctgctcacatcccttatcataataaaattgcagaatctaagaggaagtggaatcttaagagattttagaagaaaggcagtctacagaagacaagcaatttaaacaggcctctcagcaacagccattagaaacctaaatacaatggaatgtaacttcagtgagctgaaatagcttaaaattctgtacctagccaatacacttttcctgagggtaaaatatatgtttgaacagataatctgggataagccaaaaacaaatactcagtaaaataaatgttaaaggtataatgtaaacagaaaaaaaaatccagatgtgaaagtaatgatacaaaaagaaattatgagcaattatattggcaaaaatgtgactaaatcaaagcaaattatgactatataaagccaaagtaatttgaaattttgtgaagaggaaaaatatctttcaaaaaactgattaaaaaattatatacacaataggaaggggagtaaagtaactgtatactatggcttttgagtagtttgaagaggggtaagttaattgtttttaaattagcataatcacaaaaaatatagatgcaaagtacaaatttctaaaaatagaggagaaaaatagaataagaaaataggaggcacagaattgagactccaagaatatgaaaaatacaatccaggtgatagagtaagattgggcaacagtgacagaataaagattgaggaataggtaaaccaatgaaatatattgttaggagagcatttccaagaccacaaagaaacttagcagctctcaattataaataaaagttattttatgataatactaaaactcttattgaatttatgagtgagccccgaaatagaacatgtttcataggcataagacttgattaaatcactattttctctaggagggaggcccctgtgacctggggggaagcctacacacagctctcactgatggacaagaacagtggccatcccagtcaaactaaacttgtgtgaagaaaaattaagcctagacatcaccagtctgtgacctctagtaccacccttgtacctgtatcacattctactggtataactcaaatataagttcagagtgaaagcactgaatcatgaaactaagagggtaacctgtagaagaagagccagagatctgattgcatgttaggcttcactctagactgtagcctctgaggattaataaaatctttggaatgcaaagatcacttttcctctgaataagatttgtgaaatctctagaattatgcactttcatatacatctgtggttctgcctaattttaatgggtactgccttctgattctgtgggaagaaaatatcatgggactttgaaatccgtcagttgattgcacatttcttgttcagtcaaaatttacttagaattccaagtgtgcatttactaaaactgtgcttgaagggttggtagtgggtgattttaattctctagtattatatgtgattgcagtctggaaggctgaactattttggtgatggccaaccatgcagtaagaaggttaacacaatttgcaatggtaatctctctttcatctacacatttcagtcaaccttggcattatctctaaggccgaatccaagtgcctgtaagccagaagccttcaggaaagagcagctgtttttgtgctctctcacatcttgaattctaggtcaaaatgtcatgtaaaagttttttcactaaaatatctatattgatttctaggaataaaatagaaatgcctggaggattctgtgtattttccctgtaagtcactgaaatatcctggtaggccatcaagaaataaaatggattttgtctccattgtatgattgagtcctcccttgaaatccttgctattatctggaccaacaaatgtgtagagtccagactaagagtggagttgattcagtgtatgtatccatgggattttggtcaacaaaacaggactacttaaagccttgttgggtaggggtttattataggaatcagaccttacacaaacacggaagcactaactgaagagaaagtgtttaagggggactgggatgatcagagaaagaatcactggctggttttcctgaagcgctgactcaggtagacaagaagccaagcatgctctactgccaaagtaggactctgaagggggcacttcagcaaggtctgtaggaagatgttgtctttggtggccactaccactgtgagtccacagccaaatgcccagtggtaggtttggggccaccattagtcagcagggccagctactgaaaaggtggactagattcagagaagaggagaataaggatacactgagtcttgctgggtacccctctacgtatcttaggcatctatcttatgaaaaccttctgaaagtagtagcttctgtttctcttcttccttccatatctcactgaacgtctctcttctggccaattctaatgtagaaatatcaggaaagggtattgggaaatgtaatactccatatttgcctgacataagcaagataatctagttagaagctggcaatttccttataacctaggacaattaggaagtagaaattagagtctaaagcagtctgcaaactaggaagacagtggcaaacaggagtaacaggaaacgaagtcaggtgcagtagacaaacatctgtcctggtgttataggttgtgccagtatatgggaggctgagggtcagaaggtttatgcaaagaaccaaagcgaagcaagatttacctctgaaatgacaggaggtcacaggtacatgaaactcaaatgcattacaggtttttttttttctttgttatccaaatataaagagcaggagataaatttcatcaccttttgaggtgtttgttaaaacatgtagatttctgaaacctccttgcagacctaggaaccggaatctctagggttttgattcaggaatctgcattttaaatacaatcctcagatggttcttctgtgcagtctagttgggaaatatatgattcgcagagtgacagattcatgctaacgtcatgtcaggtacttactgatctgcttcagcactgagaacagagactgaattagaggaccagatatataagtgatttttttttaactgactcatacagtagattttttttttttttttagagaagataaaattcaggctggagatggcaaataaattattcatgtcacctacctagtaagtgactgggcctatactctaatttagatctacttgactccaaagtgtaccctttgagtgttgaatggagtaaaaggcttcaggcttgcagaattactgacttgcttgctaaacattcatcagtgagacccctcagggaaggaaaagtaatactggtctcctattaaactaagtctgtgtggatttctaagaaaagtcctggaggccaacattcccccaaataaaagaactagtaatggaggaaggcaggtcctgaaaaaatcactcccaagaaaaatgagaacttcacactcgctttgttttctgccccctcctcctccctctctgtggacccagcacttacaactactatgacctcttccatctttatgtgtcttcatcataccaagtattcccctttcttatctgaaaaagaaaaaaaaagaagaaaggaaaaaaaaaaacgacatcttgatctcgtttatatggaattaattttacagttaataagtaaaacctaatattttttgtctacttttttgggagcaatatggtgaactcatattggcaaagttatttaatggttttatgaaggaatagataagtgtgagtgagaaagtgtggaatcagatcgcagctgtaaagataagctgaactatggcagcgcaatgtgacccctagtccttgcattctaatttaggttctgctgggaagctttacgagattattgaatacctttctagcaattagagctggcctggatggttccggttgccttgggaatttggaaattcttctatgtgaaagatgtttctgcaggagctgatcattatacaccgatgttacaaacaattaatttataaagtacaaagtttcaatttcacagtgtttattttgtttttttctgttagctatctgttcaccagataactatcattctttccatatcttgtggaattcctgctaggactaataagataggaactggaaaatagctttgaaaatagaataattactttgaaaatagaataatatgtattatatgatatacatacaggaaagtactcctgcaacagcaacaattgtactgattctaatatcccaaatccagcggctgctcttcaccctctctcctagcccaagccatcatttctaccagtttactaccacagtctcttaaatgatctgcctgtgttctgtctgcttccacaagagtccatcgtctactcaaagttgttcagatcctgtcatttccttgccataagaggagaatcaggacaagttttgccacggcatcaaggccccgcgtgatttgtcctcacctgttttcccagtgtcatctcctcacagtcttccttggttatctgcatttcagcatcacagacttgctttctagtccccaaatgtgcccacctcatttccatctttgtctctgctcttcccgttcatttccaatactacctcttcagagagacctctttaaaccagcctacataaatgaaccccactctctccctctatcctagtatcctgtttagtctttttattaccgtacttatcactgtctgaagttatctacttatgagtctctatgtgtattattagttttctgctattataccgaagtgcaagctcaataagggtaacgtctttgtcttatatcctcagttcctagaagaatgcctgtcagatactgggttcaatgtgcatgtggaataaatgaatggataaatggaaggaattcaattatatttgacatttggtaggcagccagattcagtgaaattatggaatactggtgcctcaaaacaaaaccttttcttatgtcatttcatatacgatagtgttaccaagtatcaaccttttcagccacacagcctgaaataatgaaatggaacatagtagttggacttggaaccaacttctgccttaagcagaaagctcatgcagaatttaaagcgattattaaggaaagaaaatcctcttcaacacccacagaaagatagggcattgcttttcaagtcataagattttcagtaattagataggagaattataaatatattatttgcatgttacacattcctgtaactctaaccatccaaatatggtttctatattcaaaataggtagcaatttaaatataaatgagacaatgcctcatacatacaatataatatttaacttaaaacaccgagatggttaattccgtgtgtcagttttgctagctacagtgcccagatatttggtcaaacattcctctggatgtctctgtgacagtgcttttttggatgagattaacattcaaatcagtggactttgaataaagaagattaccctcccacaaggtgggtgggctcatccattagtttaaggtcttatcagaaaaaaattgaccttccttaagcaagaaggaatgctgccagccaactacctttgtacttgaactgcaattcttttccgcgtctccagcctgctaatctgtgccattagattttggactctgcagtctccagggacaatagcatggcacagtccctaaaataaatttcccaatcttcctctctctccttctcttcttatttctcttaaattccctttctctttcaatctctctatctccctctctcctttccctatctctctatctctctctctccctctcagtatctcatacacacatacgtacaaatatatgtgtgtttacatatatgcatatgcattatatatatatttatacacacacatcttgtcctgtttctctggagcattctgatacagacacatttctgattatagatttaatatatactatattgtagtttaaacatatagatatatagagagagatttaaaatatactatgttgtagttcaaaatatactattgaaaaaatttacataacctgtccaaatgtttatttggctattaattcaattaaacagattgacctcatctatcatttctgatagattacttctaagaaacagaagatggtaagtaatatctcatgcattatgaagtcatttaaattatttaacatgcattaaaggagaaattcaatgtagctcatttcttcaggtttactaattaaagtcagtcttgactctagaaataaaaaaaaaaatgcgtaagaagagcaactgtgacagcattaatattcagtgaaattgatgaccttagtgggttagttttatataaactgttacggtacgtacaacttgtcactgtagttcaaagttatgttcaacacaatggttcttcttaattgctcaagacactccactgtgacattggctacttcggctgcaatagagagattaaagaatcaagtcattgtattttacagttaacaggattgctaataaagaatagtagcagcatgaaaaattgtagagaggcagtaaaactgaaagctcaagggtctacctgtatagactgcgaaatccatatactgcaccaagattacaaatggtgattaaagaggagcccacgatataatagattaaaacaaaaggttaggtgtctaacagaacactggatgattctgggaggatggggcacataagacgttataaaaacagagttatattccaaggccctttttaaattacaagaattacttgtacttttactggcattagtttttgcctgcaaatgttgctagattcatcatacttttagaaagctgattacaaggttttggtctgttcccatgaaattccatccccagattttgtgacagtagcccttcatttagcaaaaactcatgagtttcttctctgtaccagttgctgatgagcttagtcagttattttttatgctgtcactgtttagggcaaatcaaaccattgtctaaacagttcactttggaatattgtgaaaaaaataaagtagagatccacttaaaaatgttgaatgtggttcttgtctttatctttgttggtactttcctgtcattgccataatcattggctccattagcacctgactggccaatcaggtcagttgactttgttcatctgagccactgaacatttctaaatccagtctcatactgcacatcaactgtggttccccatttgtaaattaaaaaaacttaaccatgtctaacccacaggaaaataatagtttctttttttaaatatatatatatttttattatactttaagttctagggtacatgtgcacaacgtgcaggtttgttacgtatgtatacatgtgccatgttggtgtgctgcacccattaacttgtcatttacgttaggtatatctcctaatgctatccctcccccctccgcccactccgcaacaggccccggtgtgtgatgttccccttcttgtgtccaagtgttctcattgttcaattcccacctatgagtgagaacatgcggtgtttggttttttgtccttgcgatagtttgctgagaatgatggtaataatagtttcttagtttacttgttcactgaaggactggatgcaatggctcatacctataaacccaacactttggaaggccaagatgggaggattacttgaggctaggagttccagaccagcctgggcagcgtagagacactccgtctctataaggtatttgaaaaaaaaaaaaaatagctaggcatggtggcgtgcaccacctgtagtcctagctacttgggaggctgaggcaggaggatcccttgagcccaggagtttggggctgcagcaagctatgattgagccactgcactccagccaaggtgacagagtgagaccttgtctctaaaaataaaaatttaaaaagttattaattgaataggagtttggtgtgggtggagttaacagtcagtaccactaatctccatattttaatgtggtttatataaactataccaccaaagatataattatttatattgaaatatcagcatgcctaacaacataattggattctatgtttatttgcaatatgagtaagtcagaggaaaactgatagagtaggaaagtcagatttcaaaggtgaactgtataggaacttgccctttggtcttacagtgctgtctcctattattttaagcattcaccttaatgataccatgaaaagtattctcaaatgggatcatataggaagccaagacacagactgttttagcttaaagggccctgagaattgagattgttttgaattcctaaacactttccttatgttataggccaagcccaagtcccaaatgtgctttactctgttccactgagttttaaaactttgtatcagttaccaacattgaatattgagagttttgatatagagatagtaattttcaatttatttagaagattagaaaatgtggtacacatccctgcatgactatgataagctggagctgagaagctacaccctctttcagatgagtcctgtgatactcagggcttcccaatccccaccagccactttattttttacatcacctgcctagaaactatatcaaatgacttctcagtcccttagtctgaatccttcatttttcccatgtaataatttgagttatgaatagaaatagtaatttgcctgaaattgaggaaaatgaaactcccccttactaagccatcatgttatatccccttcttccttattataaaaaaaattatgctgttcagggtggatgcacgtttaagtcaaaatatagaaagtaaacaaaaccattaagttcttaggcacatttgcaaaaatgactcattatataacatgctatgttccaatattaaaaagcagaaatcagttggggatttctgggaaatgtttgctctacttcctctttttattccaactctatttccttctctgtcttcctatataaaacattaagatgaagctgaagcatttatatcatgatgacgaggtaacaattattgggacaaagcacaacataaatatcatagacaggaaagacagaagagtctaaatatcataaggcgttatgttttgttttttgttaaatatgatcctgactgacataatcctgactgatacacatatatatttcacttcccatcacacacacacacgcacatgcacatacacatgcacacacatgcacgtgcgtgcgcgcacacacacacacacacttctttgccctctttgcctcctcctatttattattttattcaacagagagtgactagtgcttactctatgtcaccatattactgcactggccctgcttctacctggcagtgatggagatcagactgtcacatattgcttctaaacttagtaggctcatagaaattaaaaatagcatgttctacctagagctttaaagatcattacagtggggctattagcactgtgaatgggaacacagcctgactctgggtaaaaaaaaagaaattgaagagattatatatgggagattctataattactttaacaaaattaagagataaggcaacaaagatctaatactgtaagtcccacctgcattatttgtgctgaaacaccatgtctgtacattggctgtgacatgtaataccactgaaacacagggtgtttagcaaacatttagttatttccttaagccacctgggctaacaggcaagggattcctacgtagatggctatactgaaagattttgacaccatttaaaaacattcttaggacttttgagtgaattatgttttcagattatttagtttgggcaggttaaacagactgtttttatacaaattctaaaaaagttgacaaccctgagcctcaatttccttctctttaaattgatgattttgatgattctgaattgtaccactattaagttcctgctagatctaccatgtttagaagtctgtaacgtcactctctaacgctgtttatttttttcttctttgcccctgtgtgcacactgctagctcttctattaatctcagcagatgagggaggtaatttcgtttgaggtcaccaaaactgtaggctataaataggaagtaagatagtcattctatagtaaccataaaaatagttctcatcacattgggatgaaacaaaagtcatgtcacctcactctggagacaagagatttatctagttatttgtaattcctatgggctccagatgcatggacagaaagaaggaagatggaaacatggaaggttaaagacacatcagggcctatcctttgcttagtgtgacacaatcaaaggaagaagaccggctccctttgggtttaaccgctttatcaagtgccgctctatacattacccagagaaatgccttctgaattctagaatttcaggcattgcagtaggcagttgaagttgtggcagcagcacataggaagctttttaaacctctccatgcagctctacgatgattatactcattcattagcctttttcaacaaacaatggtttagcagctggtatgtactaaacactctgctaggccttcaaatatggcattgcacaaggcaagatctttgctatgaaaagtgcaaatgtttaaacaataacaaggtagatgttgtattagaaatagtacatggtaaaaaaaaaattaacaaacaaaggactgggtaacatgactgagggtacatcttagtctgtttgtacactacaacaaaatacctgatactgggtaatttatataaaacagaaattaatttttcacagttctgggggctgggaagtccaagatcaaggcactgtcatgtgatctgatgagggctttttttgctgagtcctcacatggtaggaagagaaagggcaactagggcaagcctccctaacactgagtgaagccccttttaaaagggccttaattccattcatgaggcaacagctctcattgcttaagcatttcttaaaggcttcccttcttaatgctaccgcattgaaaacacatgaattttggaggtgatttacgttcatcgtgaattttggagggagcaaacacattcaaaccatagaaggatgtgactaatgcagtaaagattcatatcacttttattctgtgcaaagaaggaaaaacttattttatgttgttactttagtttgcatgtctgagagagggcaagtgatccctcacatctagcttactaagatttattcacttaaggtaccagaagaattctccaccagagcaaaaaaaaaatagtgagaacctaagaattccttcatttagaattaatcctctatatgggaaatatatgtttttaaaaactgaactcatagaagcagagtagaatcgtagttaccagggtctgtttagggtcagggtgggggcattggtgcgatgttggtcaaaggatacaacattatagttaaataggaggagtaagttcaagagatctgttgtacaacatggtgacgatagttcatatcaatgtatgatattcttgaaaatccctaagagagcagattttaagtgttctcaacacaaaaatatatgtgatataatgcatatattaattggctcaatttggcccttccaaaatgaatacgtatttcaaataatcatctcttacccaggtgatgggttcttaggtgcagcaaaccaccatggcacatgtttacccatgtaacaaacctgcaaatcctgcacatgtaccccggaacttaaaaaaaaaaaaaagaaacattaaaaagtagacaatttttgtcaattgaaaaaatttaataaaacttagcctagggtattctaggtaatttacatagattatcccaagggaggaaggataggtagtgtgaacctcttaaagcaaaggtggagtgaagtgagagttcagattagtggcgtggagagtccaacccagttggaaagcaaagcagtaataggagtcatatggaggattctcaatattcacctttgttgccttaacacctagcaggggtagaaggagccaagacttaatagattaatggagtagggacaccaacccagttggaaagcaaagcagtaataaagaccaggtggcaggactggcacaggtgagtactggaaacaaactgagtgagtccacattactttcattatcctctttaaaatgtgtctttccagcatttctgggaagagaaaaacaaaaccagagaaaattcatgcttctagggaaaaggagaggaaatagatagtgcaatagcaagaatgagagtattaatgacaggaagtaatgtaatcctaaagggattagtgaactaatgcttataaatggctcaagtgcctgggccaaatgttctatgtgagaggagctactcttctgttactttctctgagctcattaacaaccaaatggattataatgggcttcaacaggattaagtgacaatcaacaatcaaagtaagacaagagtttattatgaagaatattgtgttcaaagattaacattaaactcgtgaaatatattgtagaaacttcagattacattttgctatgattttctttttatatgtcagtcttcattcctccttcagaatgctctttttatgatgatttgtacataattatttttaggaacccattgatcaatgtcctagtaatatttcattcttttatatcatcttttacaataaaattaagttgctttcagactaatttaaaaataatctttggggttaatgttttgtttccaaattatgaaaaaggaaggaattcaatcaaatattgcattctattaccaagtggattttaagtaccatatgctgtgttttatgccctatattatgtagtcagaatgaaaatgtgctccatgttttcagaatatgtactaccttcatctttcacattatttcaaatagtgagaaaataaatatacatccattcttcctcctactttctttccttatatttatctcccaactagccaccagacattctctctacatttaatacctacaaagagggctggctgctattcaggtcatctggcaagtatcatgttttctccagtatggaaaaactaagacatatgtgttttgtttacagtgtgccaaatgtgccaattcaatgagtttttggatttgttggcaaaaaaaaagagagagactgaaaaatagggaacagcattttttcctgtggccagtggtcatttgttggcacaaggaatttctgtattataaatgacactcaattctctctttgatggcctcactttgagaacagattttgaataaacagatcttaggcacacagaatttcaatcgtcgaggtgtatctgcagaagtaattagatacttgcaagtgacttttaatcacttcaacttgaatccatgtgttgcaaaaagatgtactagctaatgtgattattccaggaacatctaaaagttttcactgagtaacttttttttgacatgacaacttcttatcgtctcgatcttgaagcattggcatccagataaaggcacatgctggcatggggaaagggggggggggataatccacttgacaactggtaaagataatcatatttttataatttttgataaataaattaacttacaagccttattatgactctagtttcttctccctttaatcagttacatctattactgccagagtaattgttctatttcatatattttgtcatataatccacctcctaagaaagactgttattgtttacagattatttctcttcttaggatgacacacaggtcctttcacatgtggtctctacttggtctcccagactcagctagcctccatgagtatttcctagtgtagccatattcaacacactccctgctccctgaggtgcccatgcatttttgcccatggtctttgtcttccagtagcattgaaggagaaagaggaggaggaggagcggaaaaggagtggggagggatgaaaagaggaggcccagagaagaaatgagaggaaagaaatgtccaacgaagggaagagaaagaaaggaagaaagagagtgagagacagaatttctccacatttctcaagactcacctcaagtgatctctcctcttcaagccttccctaaatcccctgacagagagccccatgccaccataccttatgctgtgtcaccctctagcaaatttacatggtataacaaagcatgcttatctttttctccattatagattatcagaaacttgagagaagggtctgagtcttgctgtctctgtgtttcccatcacctagtagtaactagtccaaaactatttttttgaaagaaggaatgaatgaaacctgcaaattaattaaaagcgagagaacaaacaaaataaaatagatttgttcaactctgtttgtataatatgaatagacttctaaattagtctttctagttggtaaattggaggaaaattaatgaacctgaaaaaatgaaaagtaggtgtcacattataagctttctgagaaaatgacttgaaccttttatccttgtgttatcctcctttcccggcgctgaattatcttctaaaatggtttgctcaagtagaaagttaattaatttttattaagcaattagaagaaggaaagcaattttcattttcaagtaaaagaattcgaaagaaacagaggagatgactaatcattaggaatggcttagacgccgaatggtttcccacatataccaagataaaaagaatgcgcaggaggaggatgatccatggagtaatataatactgtcagtcagggtacagacaggaatgtctgccctgtcagctttgatcataccatatggggactggaaaaggaaaagatggtgcttttttacacatattctctagcttccgtttatactgaaaagttattgtaaagagaataagcagatagtttccatggttggacagcctttgtaagttttgcagatttttattgtttttaccaacagtgacatgcttaattcttcaagttgccacactcaactgaattgaattttagtgttctgttaactataaaatataatgattcatttttcaaagtttccctgaagcacatcagttcaatgacatctgtaggttaagaggatgccttatgattcagatatatgagaattcgaattcagactctataattgaccttatctgtgatgttggacaaattaaattttatctttaaagactgtttttctcagatataatatagaggtgaataacaaaaatttaaaaatagctggaatagttggatacatgatatatgccagacattctttcaagtactttatagaaatcaattcatttaattataccaataagtttatggtttaagtacaatgattgcacccattttacagaggacagaagtgagaactagtaaattatgaattatttggtaaatgaagtgtatagcacagtgtcttgtgtacagtaggcagtcactagctggaaacagatattgcttatttcttcatgtattagtctggattctccagagaaagaaaaccaataggatatatatgtgtgtgtgtgtgtgtgtgtgtgtgtgtgtgtattcctttaatatatgtattctctaatacctttatatattatatatataatgtagatagatataggaattagcatatgaagttatagaggcggagaagtttcaggatctgtagttggcaagctggagactcaggagagccgatggtacagttctagtgtgagtctaaagtcctgagaaccaggaaagacaatgatttaagtttatagactgagtgcaaatatgacagcaggggaagactgatgtaccatttcgagaacagttgggcagagaaagcgaatcatctcttattctgcattttgtttgattcaagcctccatggattggatgaggcccactcacactggggagggctgtctgtattactcagtctgttgattcaaatgctagtctcattcagatacaccctgaaagatgcactcagacataatgcttaaccacgtgactggacaccctgtggtccagtcaagctgacatgtaaaactaaccatcacaattcattatggcaatttcaaagaaggaaaacattggcgaaattgtttacaaatgaattctcaaaataaatgttctaattatattttacagagacacagggggaaagcacaaatgatgatggagtctggtttatacttcacacacagaaaacattcattcaatgaataattgagatcatcagttaattagaggtggatatacaaaatttaaaatattgtgacaggtaattgaaaagacaaagtataagaagcattaaaatgagaagacaatttaggaaaagtaaagccggggatatgagggcaaagaatgtaaaatcagacaaatagacaaaacatacattaaaatttgtttaatacaagttaaaaaagaataaaaaattattcttagagtaataaatgatgactgcacagaagaaatatctaacgctagcattttatattttacccaatttcaatccattctcagtagcaccagtagttcacttttaaaacaacaaatctgccatctacattaaaaatgtcttagataatctccgctgtctaaatgaaatcctaattcctttgtactttatttaatgctcctaaaagtttttcttactcttcatttgcagcctcatttctggacacagttttcccaatatacaataaattctatccacaatcaacttctcataattttccggaaacacaatgtgtatgttctttctttctttatatttcttgtcttttctagatgattccattcccctttttccaactagtgaatcctcttccctagaaggcaagttgatgttgatgtgataataaaaggaatgataatgtcatgggaaagaagaggagaatgttggggattatagctctcttttattagttattttggccaatccctgtagaggatatcttaactgagtattttatttaattcttacagcaaacctcctttttgttatccatgttttattgttgtgaatgctatagcttaaagagattaaatgacttatccaaggtcacccagttaataagactattttactcagttcaaataccaaactgactttcctaagaactcttttattaagaataaaaattttaaaattcgtaaagccctacaacgttctttttatattgtatctaattatatcagaaatatttacacatcagtctactcaatttgattttgattttcttgaatctaggaatgagtttcatccaccctgcttcccccatcccctgcagtgttagcttcatcacaagcagtttataatcttttatttaacataaacaaatataaaaaataaattctaagtatacacgagtgaaggcaacatactcaatagtacaaacaagaaatcaaagcgaattgcctttgtcatttaaaaaatttggaggaattaaaccttattaaaattccattaataacgttttctattaataattcccttattaaaatactggaatgtcaatagatacaggtattgaataaaactaagcacataatttaatgatttttcctaattattattcagggaatgtctttgaaaagagaagtgcaaaatatacaaaaacagaaagatcaagaagcatgccaaattggcattgtgattgccaaagcaaacagaacagtctgtaaattattatttagggattggggtggctcttgcatcagtcacaaaaagtgtggaaattaaataatatgctttaagaaatcttgtcataagagaacacagcatacttcttcctacatctatttttaaatgaatttcttatatgattgctcatgaagaggaccaatagtagtctttattgtttataaaccaatcaatatctctcagtctcaatgtgtaacctctctgtcaccattaagacagcagacggcaaaggaggggcaataaattttagcatgtaacagatgaagtagctgatagggtcattagagtaactatcagggatagagaaagctgtctcccaatatcagttcccacaactttgacttttaggttgcatttcttcataaaattcagcctgatttttctaatttccaaaattctacacttattttctattttatcttgtctctttttggatgcttttaaaaattattcctctaagtgtatacttggaaaaaaaattaatgtttctttgcaacttcaccctttgattgttatatatgcattcaactggagatgaagttgggttgaaatctggaattcaagattattttataccaaagtatatattgttttcaggtaatttttataatgtcccaaatacgtaactttttaggctttatttaattatagatatttggccgaataagcacaatcgaaagtttcaattaagagtctaggacacaaagtttggggaaaaaaaatcatagtattctaataatatgtattgctttgatgctgtatgtctaaaagcactcatgaatacctagtgcacatgtgtcaaaataaaacttttttttagagtataacaagttctttagaaaactttttgcatcaaatggtgtaaaaatgaaatcattttatataaatttagaatctgtaaaaggtacaaattatgctttgctcatcaattgtatttatttacatctaatcaaccccatcttctgtttcctactcaatattagctctattatttgattggtttggatatataggggcgtgttatcaaattatacgcacccttgtccttttcctcctttcataagtttccttcaaatttataattcttattacttatttaaatgaataatgatggagaattaataaatagaataaatataaaaagatattaatcatataatcgctcaacacattcctactgaattgattttaatttttgaagaattatcatattatattgaataaagaattagctctcaaataaatacaaataatttcttaggggaaggctgaggaggaagactgaatgagaaggagctttggcaattgggtgttaaataccatgggaaatagtcaaactcatagtagataagaatagaatgaatgatggttgccagggactgcgtgaggagaaaatggaaaattatttttcaatgggtataaagtttctgttatgcataataaataagttctaaatatctgatgtgtaacatagtatctatattaataagacagtattgtgcactttaaaatatgataagagtatacatctcatgttatgttcttaccaaacacacacacacacacacacacacacacacacacacatttattaccttgattttggtgatgatataatgggtatatgcatatttttaaactaatcaaattgtatatatttaatatgtgcagttcatgtgtatcaattatatatcaataaagctaaataatacaatggaaaattcagaataagacagagatggattgtgaaataatgttcatacattgtgttagtttttcttaggctcaaattggtgctaatttttttttattctgagagataaaaagctgaaggtttcagaatatcactaatgttttatatgtagttctgaagatttgtacaaacctctcttccccctttttaactttatataaaaaaggagaaagatcaatctgtcggtatgagaaaggaaaattataagttctatctggggatttactcgtcattaagtttgtatttcaatattgcaaaaaactcttggctatgattagagatattcatattaaaaattcagataatgtagactgttatgaagaagaagtttcaaattagctgaaataagtttcaaagtcagttaatttgttaccagcgggagaaagtcaccattatatttggcgtgtattcctgaagagcatacataagatagacataaacacaactacaatattggaaggtttgcttatttattttatagaaataatcattctgtataaaatttgagaagtgcttctttcttacagtttatcatgaccatttttctattatgatggttgccagggactgcgtgaggagaaaaatggaaaattatttttcaatgggtataaagtttctgttatgcataataaataagttctgaatatctgatgtgtaacatagtatctatattaataagacagtattgtgcactttaaaatcatggtagacatgatttattgtagattatacattttcccatcctaagaaatgcatagtttttgcttccattggcattaaataataattatgtataaggaataaatttaacataaacctcttttatttgcttattcaaatttatttaaaaatttgaatgtttgtacaaacctaaaagtagataaagtgagaagaatagcagccataaattttctcagaaaattacatgaaaacctaattaacagctggtgataacaatggtgaaactaacttcccaagattttaaaatcagtcatttaaaacttacactgtcaaacatcaagttcaatattcattttagtatgcgactctgcaatcgacaaaaatacatttcttttaatttatgaaacagaaaatatggttgttttctctatttcttctcttaagacattatttaatcatctgtatctttcttttattgatctcttccttttaaaatcttcattactcttgtcttttctcccagctagtccacttgctctgctttatcctgttatgatcttcttctaatgctcaaccaccattccaaaagggcttcttcataatttaaattaataatgtgagtgtgtgtagaaaaaaaagcgtagaagttttattttaatgtttttgagcaacctaaatgcgtggaagatgcatcatcacgcaattttaaaaataaaaatgatagattgatatattttaatttgtattacatgctatctgcttatgttcttcacatgttaatggctactgaaaataaaaaccattacaaaattctcttgaagcctttaaacagaagaaacaaccttgtaaaaataaatatttgtctatgtgtctgaagagaaccttcttccacagctgtgtggaagaaccttccacagagcataggtacatgttgcccttttttcaatatttaagatgttatatgtcatatttaaattgttgtagtattccaagacagtaaaactagtgatatatttaatgtgacaataatgtgttaatttttatttcaagacatcttgtatgaactactatttttgggaagaattcacctgccctggattgctatgctctatttggaagtacatatccaaatatcagtcatttatctctattcctaaagtctagtaaatgcaacaagcaatctgaaaaagagaactgcagctgcataaaatgagcataattgattactaattgatatgcatctaatagagacttctttctacccctttagtatctttttatttattttgaataatgttttcatgtttggcccatttccttgttctttctccaccccaatctcccttatttatttaggtcaacttgacaaccccttttttttttgagaatgaattcgatgtcttaaaatctctctctctttttatatttattttagtttggcagcaaacattagttctcgcttgctatattttactcatcaaagtgttaacatcattcataaattattaccaatggtaggcactggttgttatcaatcaccagggaataattgatgctgattgaatcaaataaatgtggtgtttgtgaaactatgaccttgtcattcaacttgggtacaaaaatctattagatctatgagaactgaatcttaaagataactgaagaaggcagctttctattgacttaaacaaataaaaatgtctttttatttgaatatttctttctttacaatacatgatagtctaaagctctgaaaaacaacaataaaatcactactaatctcccttatgtgagactaaatgaagggtcctgggaatattaattctgaaagaaagcttgtccagcctcccattttataataaactatatcaattcaaggactacacagagtaaattttttcaagttgtatagttctctggtttgaaagtgtcccccaaagtttatgtgttggaaacttaatcccgaagcaccagtgttgagaagtgggacctttcagaggcagagccctcatgaatggcaggattaatgccattattattgagtgggttagttatcatgagagcagattcctgataaaacggtaagttcagcctccttccctctctcactcttgtcttctcttgcctttccacctaaagccaggagatgacttagcaagaaggcctgcatcagatgctggcaccatgctctcatacttcccaacctccataaccataagtcaatacatttctgttctttataaattacctagtctcagatattctggtatagcagcacaagtgaactaagacacatagtgagcctttagcagaaccccattttcctaccaacctctcatgtcacctcccacaatgtgcattttcttttatttatactaaaagtgaccaaaaaaaaaagtttagaattgaaactatttccagttggtatcaagatccagatagagttaaccttaatatatatgtgtaaaaagctacaattcaaccgagtctctaaggcttcaaatatgaaaagaaataaaatgtgtttgttgttttgatttagccacaaatcagtgatttaatttagctactcttttccaaatgactatgaatttgatactgagtcagtgctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccaactatggtaattgttgctcctttttttccccctctctgtttcacctgctcaatgtttaacataatcaaggtgaacttttttagagaggcttgcttcatttttcacattgctatgaccattcctacagtcattgtcaaatgcagtcataaatcaaatatctggacataggagtttaggctaagtaagttacaaagttgttttggcgtccaaaacttaattgtataaatatctccaggggatggagatttctcccctgaaaatagagcacttggaacagaaattcagattgcttatttcatataatacaaattccttataaaacaactctttaatctacttaaaatccaatagcccattaaaattatcatcttatcttagaccccattataattcttgtctcattccttcctttcattctctctgtctggcttttttttttttttttttttttttgctaatttttattttcttaattgcattgcatggatgtgtacattttgtttattctgttttgctttgctctgatcatgagggtctttatacttggaaataacaaagtgtaacttaaaaatacaaatatactttttgtgccacatttagagaccaaattcttgattaattattggatcaacatgagttctgggataattcttaaaaacttagtgtgtcatcatgagaaaatcaaggataaccattatcagaagtaaatgtgcaaccagttaaaaattcatatattataggccctaattttatttctctgtccacccaggctggagtgcagtggcgtgatctcggctcactgcaaactctgcctcctgggttcaagtaattctctgcctcagcctcccgagtagctgggattacaggtgcccaccaccccacccagctaattttttgtatttttagtagggaccaggtttcaccatcttggccaggctgatcttgaactcctgaccttgtgatccacccgcctcagcctcccaaagcactgggattacaggcgtgagccaccgcgaccagcctgaaatatattttaatttggttttgcacatcattaaattggtttcccatcatctttgactagcctttctatagttcctgtatttctaagttctcaacatggaaatcaactagttaggatacaggccggtcacctagactaccaatcatctgaacttgatttggaattgatcagtaagaaaaagcaggctccctgcagtgcttctaagttttgttaggtgaatggtcacaggatattttgttttcgctggcatcagttgttgtgagtgaagttcctagcatagaagtggcttttgtagtcctgaagcaggtagacattttctataaaggctctatggagtagaagttattgtttcaacagccagtttcatggtgtggtttcagccaacattcctagaagcttagccctgatctgggttttttagttctcccaataaatttatcagctgcccacacctttcattttttgccttcagttttattgtgctataattgacaattaaaatttcatatatttaagatgtgcaagttaatgatttgatggacattatgaaacactcaattaccacaattaagcttattaacttctatcacctcctgtagttactatcatctatttttgtgtgataagaatagttaagatctatcctcttagcacatttcaagtatataaaacagtatcaactatagtcatagtgttgtgcattaggtctctagaacttacccatctcacagaattaaaattttatgccctctgactgagagcttctcatttccccctcccctcagctccttggcaaccaccattctactttctgcttctatatgtttgatgattttagtctccatatataagtgagatcctagagtatttttctttgtgtgtttggtttattttactaagcttaatgaccttcaggtttatccattttgttgcaaatgaaattatgttcttcttttttaaaaattaacattttgttgcatttataaaccacaccttctttatccatccatccactgcaagacattttagttgtttccatattgtggctacttagtgaataatgctgaaatgaacacagttgtgcatagatctcttaaggaccctgattttgtatcctttgaaaatgtgccaagaatcaaggttgttgtatcataagatagctctatttttatttttgttttttattttttttttttagcaacttctgtattgttttctataatggtcataccaattcacatttctcaaaagaaacatacaaatagcaaacgggtatatgaaaaggagctaaaatgaactaatcatcaggaaaatgcaaatcaaaaccacactgaaatatcacctcatacctgttagcttggtcattatgagaaagaaaaaaggtaagtgttagcaaggatatggagaaaaggaaacccttgtacactgttggtagaaatgtaaattgttacacccagtatcttttttaatacactccctttagctttaattaggtaaaatccaatattgttgcttgtagtcaagaattctggtatggccttcctcaaactgttattcaattaaaggacacccgaagatatatgaacatagaatgatgtatgtaatatatatagaagtcaagaaattctagcttaggtcctggctccaatgtgttcttactgtatttgagcaaatcaattaaattttggcacttcacttttcttgcatgtagaattgttttgagaagagaaatttttattttttattttatctttttttacaatttttgtgggtacatactaggtgtatatatttggggggcacatgagatgttttgatacaagcatgcggtgtgaaataagcacatcatggaaaattgagcatccatcccctcaagcatttatcctttgagttacaaacaatccaattacattatttattttaaaataatgaaaaaaatgcaatgttttaaatttctttttgttcttctcagtattttttaaaattcttgagccaaggatatatatttcatatttaaaagatgacttcttattcttgatgcctatattcttcagcaatgtataataagatcaaatgaaaaccaataattaaatgtcactactgttcttgtgtgcctaatgcatatgcattccattgtttcatggtattcgggtctgttttccttgcacaacttttcattgcgctagtcttgacttttttctgtcaaggaagacatctttaaaaggtacatagacactttataaaaagttgttccttctgggcacttatgtccataggcgaactgcttagcaaaggctcagtggcttgctgtattctggtagaatacagccctgtgcaagaatatagccagagtatagattgacattcggccacctcttattctctaagctgagttgttttgtgtagagaacaaatcacacaatcatatgaagaaggcttcttatatctacatataatacatacaggctgggcgcggtggctcacgcctgtaatcccagcactttgggaggctgaggcaggcggatcacgaggtcgggaggtccagagcagcctgatcaacatggtgaaaacccgtctccactcaaaatacaaaaattagccgggtgtggtggcgtgcacctgcaatcccagctactcgggaggctgaggcaggagaattgcttgaacccgggaggcagaggttgcagtgagccgagatcgtgccattgcactccagcctgtgtgacagagcgagactccatctcaataataataataataataataatattacatacatatatgtatttatctacattcacactttatatcagtgatgatattaaaattagacatttaaattaagtttggtaagtcatttcattttactagaatttaaattactgcctacttcttacaatttaaatatgttaagagactttggaaataattggaattcactaataactttatactgaaaaacattttcaatttgcccaaattgtatactaatgaatataatacataaggtaccaaaaaagtatacttaagaattacaaataattaccaatgttataaaatactatcaaatattgattacaaatttttcaaatttttggttcatcagcagggaaaatttttatcctctggaaaatctaagtatggatatgggttaaggtcctgaattttattattattctcactatcagttgttgtaatatttagaaactataattaacaataatgcttaatgtatatctcccacttttttattgttcctagtactatattgagaaaaaaaaaactaataataaaatgggggcaagtactggggatttctctgtcaagcaaggaaatgcttttctcaagaaaaatctggaagcttgtcagtagaatgtgagaaaggaaagacagttggtatttagctgctgagctcaccacctcctgtgcttattacattcttaattgtttctctcttaccccaactgggttcatgatgcaggaccaaggatgtcaaagtagcactagtattttcagagcagtgcattagggcaacctaatgcctgatctttccatcctaatcttaaaaatgctcaaaccccatgtctaagcttttgctgttcaacacatcgccactagtcacatgtggccattcatatttacattcacattaaataaaattatatattcagtctgtcagttgtactagccatgtctcaagtgctctagtcgcctatggctatggctacgatatagggcagcacacactgaacatttatatcattgagggaagttctattaagagtcctgacctagcacttacttaaatgctaatttgtatttttaacttacagttccctggcatcttgcttgaaatactctggtgacatagtaaaggtctcattcccatactgaatgtgttctttccatttaatagttgccactaggtaattagtagtgtctcatgggatgacagacagcagagcacagcagtcacaatgttaccgtgttttagcctgtaaaccttttgacaaaggcacatgttcctttatcacaacttgtttgtcaaagtagagtaattaacatattgcatccaatctgagataccatcaattgaaagatataccattattttgtattttcatgaacaattaaattaatgacattccgtttggtctacagtctgcccaattccagagatgttaaagtgtgaaaaaagtgtgcaccttaggtttattgaaatttaaaataagaagccaaacttttactcatttccaaaattgaatcttattgcaacatacagaaaatgaagcaacttaaatatagaaaaccttgcttgttagtgtttcaatggattgagaggcttcttaaaatacttctctattcctttattcattttatgtatcttgctatattttaccccactctaactctcttgcttttgggtgttcagttacacatacgttagaatattttatattgctccaaacttttttcctaatacttcttctctttgtattttaatttgagtaatttccactaacctatcttcaagcttaccatttttttaatggtgatatcgaatctactaccaatcagtggcaatttatatttctgttttttattttttccatttccagcatttcttttttttaatttcttttttataaattgtttattttaggtttggggtacatgtacaggtttgttttatgggtaaattgtgtgtcacaggagtttggcatatagattatttcatcacccaggtaataagcatagtacccaacaggtagtttttttagtcctctccctcctcccatcctccaccctcaagtagaccttggtttgttccctttgttgtgtgcatgtgtactcagtgttcagtttccctcataagtgagaacatccagtatttggttttccgtttctacattagttcatttaggattgttttagtccattttcatgctgctatgaagcatatctgagactgggtaacttataaaggaaaggggtttaattgattcacagttatgcatggctggagagttctcaggaaacttacaatcatggtggaaggcaaaagggaagcaggcaccttcttcacagcgctgcaagaaagaaccaacaggggaaaccctcacttgtaaaatcatcagatctcatgagaactcgctcactatcacgagaacatcatggaagaaaaccacccccatgatccaataatctcccaccaggaccctcccttaacacctggggaattgcaattcaagatgagaagtgggtggcaacacaaagccaaacatatcaaaggttatggcctccagctatatccatgatgctgcaaaggacataatctcattctattttatggctgtttagtagtccatggtatgtatgtaccacattttctttgtttagtctcctgatgatgggcatttaggttgattccacgactttgctattgggaatagtgttgtgatgaacagacgtgttcctctgtctttatggttgaacaatttataatcttttgggtatataatgaataatgggattgctgggtcaaatggtagttctttcaggttctttgaaaaatcactaaattgcctcccacagtgtctgaactcaattacattcttaccaacagtgtataagcgttcacttttctctgcaaactcaccagcagcagttattttttgactttttagtaatagccattctgactggtatgagatgactggaagaaggtacctgcttcccttttgcctttcaccatgattgtaagtttcctgagacctctccagccatgcataactgtgaatcaattaaacctctttaccatctcattgttatatttgcttttctctaatgattagtgatgttgagcgtattttcatgtttgttagccatttgtgttttttctttcaaaaagtgtttgttcatgtcctttgcttaatttttaatatggttatttgtttttacttgttgatttgtttaagttccttatagattctggatattagaactttgtcagatgcataaattataaatactttctccagtctgtaggttgtttgtgtgtgaatagtttctttcactgtgcagaaactcttcagtttaattaaatctcacttgtcaattttcatttttgttgcaattgcttttggtattttcatacaatcttttccagtttctatgtccagaatagtatttcctaggttattttccaggatttttatagtttcagggttttcatttaactctttaatccatcttgagttggtttttgtatgtggtaaagaaagggtacagtttcattcttctccaaatgtcttgccacttatcccagcaccatttattaaaaagggagtcctttccccattgcttgtttttgttgactttgtcacaagattatagttgtgcagctttatttttgttttcttttacgtgttccattggtctatgtgtctgtttctgtaccagtcccatgccattttggttactgcagccttacagtgtagtttaaagttgggtaatatgatgcctacagctttgttctttttgctttatttctagcacttttatttccttctttcttatattatattatattcttttatttcattctgctgccatttcccatctaatcatgcatatgtcccaacttgtccactagattctttaacatagtaatcatctatatattaaatttcacaggtgggaattttaatatacagatgattaatatgttaaatatatgtgtcatatataagcttagttctattgttttatcttttgacagtgtattatttattttacttgcatctttgtgtatcttataattttggttagaagccatatatcttcagtacagtagtagaaacttattaaattgtttatatactttatccagaaattaccttttttttggtaagccctttattatagggagttgtgccaatattcaggtgctgagtgctatggtttgaatgttcccgccaacattgatgttgaaatttaattgccattttaacagtgtggagaagtgggacctttaagagatgattaggtcacaagggctccacttttataagtgaattaatgccattattgagaaagtgtgctcttgataaaagcatgaatttggcttcacttttctctctgtcttacatgctcattcaccatgtgatgccttccacaatggaacaaaccccaccagattctggtgtcatgttcttgaatttcccagaccccaggagcatgagccaaataaacttctatttgttataagttatccaggctgtggtaccctattatagcagcagaaaataaattaagacactgagtttctggtttgctgcttctggtcactctcagttcaccacaggcttccaaactctctgatttaccttatgtttaaagggtgggctggtctgtcaggtagtttctctcgatgtctcatccactctcaaattcagatctcccatgtgcacttctgtctcagagaaggtcgttctttccacactcttataattccccctggctgtagactgttttgtattactcaacactttctagcctagtgttggcagaaagggaggatgacatttttcatttttctgttttactatcagccttaggtaggaaagtatgtcatgagttttgagggtagaacccaatatgaaaatcctactgttcttttatcagtataaacttatttaataatctgtgcccagaatgtatttcaggccttcccttaggattttttttcttctatttctcctgagggtagaagtatttgctgctattttgcaagtggtataaagcttttgttctacagtaaatatagaaaaggatctggtttcttagactaggggaatatgtgttattgttactgttattgagtaggacattgtaacaaatgtaatctattgctgatgggaatgctattagcaaaaggtgtacatttggttttggctatcagttgagaagtaatctatagcaaataagtaaataaaagcatgatgttttattgtatttaagtgtttaaggtcaatagcttgatcttcagagataaaactaaaactcactattgaagagcatgaactagacagtcagattagttgtgtactgtagttaatagaaaggataagaatgcaaacgggaaaaattaaagtcaattcttagtcttcctgcgttaatttaaattgtgtttgcaagtgatttaaatactttcccaaaatgtcttaaggaaaacgacttaaatggttcatatagtcagaaagttcccaggtagttctagctcccattgtgacttaataatacatatctttatttatttttcttggtttctttttccatcattttggtcacacttaagacagatattctctgtggtggcaaaattgctccagtaatgtcccacgtctttccagatgaaagtgcagccagaaataatgtttgcttctgttccagatttgttatcaaacattgcatgatgcttattagctctgagtagttacatagccattgtatcagtcattgccaccatagcataatcaagcctctgacatggtatccctggcatctgagaagagccagattccttctaaacacattgacaaagagtgaaagaaaactatattccaaaacaatattagacatttttaggagaaatagaattaactgatgccagttgtctgttttagtcaattgggggtgctataacaaattaccacagatgggtagcttaagtaccagacatttatttctcatagttctgcaggctgggaagtctgaggtcaaggttctggaagatctggtatctggagagggtctgccttttggttttcagatgcagtcttctcattggatcttcacataacagagatcagagaataagcacactttcttgtttctcttataagggcactaatcccatcataagggcttccagctttatgatctaattatctctcaaaggccccatatccaaatatcatcacattggggattagggttttaacatataaatttggatggagaggacacaacattttgtccacagaagtggccaaaaaaacaaaaatgactattgtattcaaagatcattgatagttttcatttacttgatatttcagaaactcattttctcatccttttctagtattcatgtttctctagaattcaaagacatactggtctaatattaaactgtgttcaccatgccaatttaccccagtttttgtaagctttttatcttaggttcagtctaagagtaaaaagcattgtcttttattgtaggttgcaattttgagaggctaagttgtgaaagagcagaaatgtgactacgtttagaatcttcttttgcaactaactttacttttaagctgttttatgctgagatatatacctaccacttaaaatatctcaatcaaagtctacgttaaagctgccattctcaaataaggactatgtattcatttgtcatttaaaatatattctatcatgtaatcctttcagtcaattcatggggaagataatattgtctacttgatgctgacattgctctgatcccaatgataggccaaataaaagttagattaaaaggcatctccctctgacttcaaaatttttgctaattttaatgtaatatgatatgtggatgaacaggcaaaaaattgagtcacatgagttttcatgttttagagaaactattggaaaaaaattgttaagccatgtttgagaaataaagaatattcctggtttctaatattatacaaacctcagttgattattttaaactagtgatgatattcagggcatgtctaaaaaaacactgggagtataactgtgttcatggttgatataattaattttgattcctgttttcattgttcataaaattataattttcaaagtatttgaattctaaatgttctgttttatccagtttttctttttaaattcatataggtttttaactgggtaaatgagtaagaaaaatatatacatttaatatttgagttctggtcttaaaataactataacagttttataaaccaagatgatattttaatttaattatttaaaaaatatattttttggtttgcattgacttactaaatagatttgcagttcagaataaatcataagtaaatgttctaacttgaactaggacttaaataaaaaattaaattaattcaaagttttcattcaaagtctagttttgtgctagttcatttggtagcttttagcctcaaatagctattgagcactggtagcatggctagtgctacattttgaaataacaatattttagatatgttacattaaataaaatatattattaaaataaattacagctgtttattttcagttttaatgtgactgctagaaaatttataactataattgtagcttgcattctattagacagcactgactagatcaatctgcagatctagaaatttagaaagccctttagattttaaatcttctaaaccgatgcctacaaaacaccaatatttaaaatcattttctttctcttagctaaccagcagctttgtgagaatttttattcagcatttctagagaccagcagctttgtgagaatttttattcagcatttctagagaatgctgaagtcactgaatctcaccacttgtgccccatctgtatttatgcaaatggaatagtgtgacaactgatatgtaaaacaatatattttattatgtgcatattctgttattcatagtgtattcaaaaccacttataaggcaaaagaactggtagatgagattgtctaccatcatatactcagtattgacagctgagaacagttttcagtagtagaaatatgtgcattttcttgagcataactagtggaatgttgaaaaagtagtactcattgaggaattatgccctgtatttgaaaatcttttagttattccattatagaccttggtgtgcttttgaggtgctcttgaagtgataaagtctttgttatgttggttggttggctggttggatggttaattaatttggtatcttggtgtcatatttcattagcagacacacttgtacaaaatactctatttttttttcctatgacctaatcaggtcattttgtttgtgcatcaagaggcatgatacccatttcatgtaaatcatttctagatagttagaacataactgtaaaaaatattgaaaatgaaggacaagggcaagaaaaaaatgagctctttaggaattagaacaattattattttcctacagatagcctaagaaaatgatgcacagttaaaagagactaactacaacatttaaaaatttttatcttgtccctgatgctttcgtttccttccttgattgattgtcatcatggcgccccttctttctttctttctttctttctctctctctttctttctttctttctctctttctttctctttctttctttctttctttctttctttctctttctttctctttctctctttctctctctctctctttctttctctttttattgagacaaagtctcactttgtcacccaggctggagtgcagtggcctgatcttggttcactgcaacctccgccacctgggttcaagtgattctcatgcctcagcctcctgagtagctgggactacatgcaagtgccaccacacctggctaagttttttgtatttttagtagagactgggttgcaccacgctggccaggctggtctcaaactcctgacctcaggtgatccgcctgtcttggcctcccaaagtgctgggattacaggtgtaagccactgcgcccgactatcatggcttatattttaaaaagtagttatgcagttatatataacaattaaaaccctcgcctacatagcttaatatgagtctctggaaaattttttcctctactctctctccaaaacagaacaatcattaatgatatagtttgggatttaattgatatcctttgttatactgtatttccaatgcagccaaatgcgattttattattcagctggctatcttttattcaatgtcaggatgagttaatcactttctttctaatagttaccacatatcagtgagttaatgtcatgatgaatatatccagaaaggaataacataggctaaaatagaatattataagaaatattctctatctgcctgtttcacttcaagtattataatattgaatgcaattgctaattaaaagtttagggagtcaagacatgcctaagagtacccagataattgacctagataatcctaataacaagttaggtgccttaaccaagtcattgaaagaatcgtatttcttctgtccagtcgtgtgtcagccactagttgttaaatatctcctgatacatttcttaattcctcactctgtttcctaaactgttcggtatgtaattgttacctggactctaaagtttctttttgtatggactaggtgtgatatttcaaacctgtgctttttactcatattttgggttctgactgtgatatagcactgggaggagattgtaaaacatctgttgagagtcactgccttatctatagtctgaactaaaaatgtctctcttcagatgactccaagagttcatatatttataaattgtatctaatgatttttatgattcggaaaatttgaagaacgtcagagtacactttaaaaatggaggaaagtggccaggcatggtggctgacgcctgtaatcccagcactttgggagaccaaggcgggtggatcacctgaggtcaggagttcgagaccagcctgaccaacaaggagaaactctgtctctacaaacaaaacaaaacaaaacaaaacaaactagctgggcatggtgacgcttgcctgtaatcccagctacttgggaggctaaggcaggagaatcgcttgaacctgggaggcagaggttgcagtgagccgagatcatgccattgcactccagtctgggcaacaagaacaaaactccatctcacaaaaaaataaatgagtaaataaataaataaataaataaataaaggaggaaaggaaaatttggagtcataaaatcagttttctagtgtcaacatggcttttggaatcaagcacaagtgggcacagaaataaagaaaacaggcctacatacttcatgatgtttttttttttttaagatttttttcttatttttcttatttttgctgtaaatcgtatgtactctctccaccttgccggcagttacatgcttgtgacatgtatccttcctaagagggaaaaaatgttaattactgaacctcagattctgatgcctggtctgatttatagtttatgggtgatgtgtttggcattttcaaggctcagttggttttgttgagcttcaggactgaagacttggtcccttaaagaagaacattctgcttttagtaataaccaggttaatgtgggccacatgccagtccagctgaatatgcatgaagtgattgaaattgaaagtcagttccttacatgtttgagtttcatgctatgaggaaccttacaaatagaggtcagagggatttttatgttgaaaatcagtagagtgttacctttgctatggaagaaaacaactttcttccgatattaatgtcagcattagagtaattgctctgtgaaactctgtctctagagttccattctctcttgaacaacaaatctttatcatcaccttagtattcaggtcatttttcataagtagcacataaagaacacattaatctttatagatgtctgcctatatttttatctcaaggttagttattgtcaaatattgtcaacccacagccttttcctttgccaagagttctctattaactcctccaataacctcccatcttttaaaataaaaacattgattttccctcaaagatgttatcattacctggaaactgaggcaaacaaagttaagtcatgtgttcaagttttcagtgtaaatgctgaaccagacacacaatccacacatatattttaatccacaaactcactattaaagttataatgcagactttgacgaatatgacgagcaacatattaattaaaaacctgaacaagtaaataatgttcatgaccaatataaatggatgctttaaaaaaaaatgactcaaacagatgtcatcaagatggcttactagaagcctctagcactcacctcctccacaaagaagaaccataacagcaaaccacacacattgaataggatgtttaagggagaacaatgaaattcagcaaggaagtgatgaagaccatctgaggcatggaagcttgagatggtagcatagagagggaagcaaagaatctggccaagattggctcagagccaagaggtactccccatttctgagaataggtgagtggggaatgccccaaagcccacattttgacaacagatacctgcaattctagctatagtagagcccctcaggcctcataggccctaagttcaccagagggagttgcctggagttcataggattttattatcccagagaaaaaaaattaatgctagatcaccttcactcgttgggacccaggttattgcagcacaatgacattttgagagcatggtcaccatcagagtacatccttccctgaggacgaatagcccctgcatttccacatccctggggcctgacatccatcccacatccattcagagggttgcagtgttgcgccaccagctggacccaatagttcagctgtgactgttgtactgaagcacatgcaggaccctccatcctagagtataaatagtctagcacagtgaggaagctttcccccggacggagaaagctgacatgcatattccccagagccttcaagccaccagttcaaggcataacaccacaaccagcaattacatttactccagcagcagagatgccatgaacttgtgcatttacttgaagggtctgaaggctggtctgcctggtatccccacctctgagcaaacttgtgccatggcaaataatcacagaatggccacaaaggcacttagagacactgctgacattgattaccaaataatttttatagagactatattactgtgcccactcagaaccaaagccaaagtattttatccaagtaaaactgtaggacacacatagagaaaaagatctttccctataaaagctacttcataaaactggaagaagagattgttccaccagatgcacagatattaacataggaataccaaaaaaaatatgatttagaaattcaataaaaagatagctgtattaaaaaagaaccaaacagacatattaaaattgaaaaattaaataaatacaataaaaataagtgcttcatcaatagactaaattaagtagaagaaagaatttctgaacttacagacaggccttttgagataaatgcattagccaaaagaggaaaaagaataaaaatgaatgaagcaggactacgggacgtataagaggacattaagaaaacaaatattggaatcatggaagttccacattaagcagagaagaagaaaaacatagaaaacctgtttaatgatgtaatagctgaaaactcaattcttggaagatgtgtggcatgcagataacaagctcaaatatttccatgtagatttaacccaaaaatgtcctctctgaagtacaataaataactatcacaagataaagagagacttctaaaaacagcaagaggaaagcatcaagacacctatgaggaaatgtcaatcagagaaacggtaaatttgttagtggaaactatacagatcaggaaataatatgataatatagtcaaaattcagggaaaaacagacaaattaccttccagccagaaatataacactcaggcaaaactatcctttagaaattaaggagaaataaagtgtttcccaggcaagcaaaaattgagggaattcatcaccactagactggtcctacaagaatgcttaagaaagtcttacatttgaaagcacatgggcaatctctaccattataaaaacatataaaaatgtgaacctcactggtagaacagataaataaatgagaaataaaacagaatcaagttaaatcaatatagaaaatcaacaaactgcaaagataagcaataagagaggaagaaagaaacaaagaatttgtaaaacactagaaaacaatgtaaaaaatgataggagtaagtttttcccagtcaataactgactagcatgtaaatgatttaaattccccaataaaaagatacagaatggctgaatcgattaaaaaacaagactcaactatatgctgcccacaagagactcacttcatttgtaaggatacatgtagactgaaagtgaagagatggaaaaagatatttcatacaaatggaaataaaaagtgagcaggaaagctatatttatatcagataaaatagactttaagtaacaaaaaaagaaacaaagaaggttattgtgtaataataacaagatcaattaagcaagaggatataacaatgttaaatatgtatgtacccaataccatagcatccagatttacaaagcaaatattgttagaactaaggggagagagagtctccactacagtaaaagctggggactttaacgcctgactctaagcatgaaacatatcatctagacagagagtcaagaaacataggtcttaaactgcacttaacaccaaatagacctaaaaggcatttataagtcattttatcctttagctgcagaagacacattcttctcattagcacataaaatattatttagcattaattatacttagagccaaaaacaagtctcaatatatttttgaaaactcaaaattatatcaagtaagaggaagcagagcataaaactttagaaaattttcagtctgatgatgcaatagaaaagaaaaacccattttctgaagagaaattcaagccagctgcagaaatttgcataagtaatggggagccaaatgttaatcaccaaggcaatggggaaaatgtctttaggcatgtcagagcccttcacggcatccccgcctgtcacaggcctggaggcttaggaggaaaaaatggtttcatgggccaggcccggggcccccctgctgtgtgcagccttgggacttggtgccctactttccagctgctcctgccatgctaaaaggggccgcggcacagctctggccattgcttcaggtgcaagcacccagtcttggcagcttgccttgcacatgatgttagtcctgcaggtgttcataagataagaattgaggtttgggaacctctgcctagatttcagaggatgtatgggaacacctggatgtccagcagaagtctactgcaggggtgcagtcctcatggagaacctctactagggcaatgcagaaggaaaatgtagggttggagccctacacagagtccccactagggcattgcccagtggagctgtgagaagagggccactgtcctccagaccccagaatgttacatccactgacagcttgcaccgtgcacctggaaaagctgcaggcactcaacaccagcccatgaaagcatctgactgggggctctactctaaagccacagtgggtggagatgcccaaggttgtgggagcccacctcttgcatcagcatgccctgaatgtgggccatggagtcaaaacagatcattttggaactttaaggtttaatgaatgccctcttggattttggacttgcatggggcctggagcccctttgttctggccagtttctcccatttgaaatagttgtatttacccagtgcctatacccccattatatctaggaagtaactaatttgcttttgattttacaggcttataggcaaaagggacttgccttgtctcagatgagactttggactatggaattttgagttaatgctggaatgagttaagactttggaggattgttggaagggcatgattgtgttttaaaatgtgaggacatgagatgtggggggggtgcatgggtggaatgatatgatttggctgtgtcccccacccaaatcttgtcttgaattgtagttcccataatccctacatgtcataggagggacctgatgggaggtaattgaatcatgggagcagttaccttcatgctgttctcatgatagtaagttctcaggagatctgatggttttatagatggtttcaccccctttgctcagcactcttctctctttctgacttgtgaaggacatgtttgcttccctttccaccatgtttgtaagtttcctgaggccttcccagccatttggaactgtgagtcaattaaacctcttttctttgtaaattaccaagtctcagatatttcttcatagaagtgtgagaatgaatagtatggaatcattgtaagtgtccatcaccagctgaatgaattaaaaaattgtggtataaatatacaagggaataatatgcagctattacaaaataataaaattctgttatttgcatcaacatggataaacctggaagacattatattaagtgaaataaattaggcacaaaaagataaataccatgtgtatcacttgtacgtgggaacaaaaacatttagctcacagaagtaaagagaagaactgtggttattagaggcttgaaaatgtaggagtaagagaagatagaaagaggtttcataaaggatataaaattatagctagaaaaaagaaggagtcctagaattctatactacctcgggcaactatagttaacaataatttaatatatattttcaaaaatcctaaagagaggattttgaatggtcacaacacaaagaaataataaatgttttaggtgatgagtatgctaattacacagatttaatcattacatattatatacatgtataaaaatatcacattgtattccccaaaatatgtacaattttatgtcactcaaaaattttaaaattttctaaatgacaagaatattttaaagatctctaagtaaaaagttttaaaacatttttaaataaaatttttattcaacaatatttaatatgcttctcagtttaactagaatttaataagaataagatgttttaagtagtcaatatttagagtgtgtatatgtaaccaaaatatgaaaatgtattagtattctttacaattaaatgtgttttaaaggtgcaatataatccttgtaaggaaaaggcaaacaaataaataagtccacaattgaccagtaaaagacaaattatgtatagaatgtaagtataacattcaaataaagaaaaatgacaaattacagaacaaattgcattgagcaactttctggttacttggggaataaaaaacaaaagtggatgtatacctcacaccgtaaataaaaaataattattgcttaatgaagagatcataaattttaaaagtactagaagaaaaaagtgtgtgagaacttacaatgttaagctagttaagctacttttggcatgctacttaagtatgagaccataaaggaactaacttttagagtaaacatataaagttttaaaaattatctgtggaaaacacacaaaatgaaaacacagatgctaaatagggtaaaatgtttactacatacataaaaacaaagttataatctgtcatataaaaagagcttttagagatcaataagaaaaagatgaatgaattcccaagaacaaacaggaaaaagacactgatatataagttatgaatgaagaaacacaagtgattacagcttatgacaggatattcaagctcaatcataaactacaggtctaaatgatttgttgttgttgttgctgctgtcattgtcattgtttttccttgaaataatttaaattacctcaatggcaacatgattttattgtgactttgaacaaagagagagatgcttgtgtagcatgtaggactataaattgttttagccgtagtaaaaaatgactggtaataggaatcaaaatgtaaaatgtgcatatcttctgatctacacattttacttttgagaatatatcctaagcgtatgcaaaatatgtaataaaaataattttagagttttttatggtatatggaaaatatgaacaatctaaatagctattaataggtaaatacatatattataatacttggaatttatatttattaccatttttctaatatttaaaaaatcatttaacacaggtatgttaattatgtatgagggtatagtgttatgcaaagttacaaatacaaaatcaatacaactcattttaaggattttctatctctgcttggtagtaaaacttttatggaataagttaacaagttgcaattgaaatagatttgagcttttctggttgtaatctcttgggcttagcctcaggtaataaccaaaaaatttccatatatttttgtcctttaatcctcataataaaacatttggatatatattattttctctattcccttgatgagtgaattgtggtttttttcccctttctttcttttccttccttcctgccttcctaccttccttcctttccttccttcctttcttcctttctctctctctctctttctctttctccttctctctctttctttctttctttctcttccttccttccttccttccttccttctttcttcctctttctttctttttcttttttcttgtaaactgctaaggaaaacacaagctaagatttgatcctattgaaatgaagacaaccttttctccaaagctgcttggaaatgaaatgaccacttttcgaagtcatggtttattcagttaacaagggcttgtaatttcctatgtgttgaaacaataattttcatccttacaattctagttccagcactaaatggaagctaggttgggagtttggctctctgtcctattgcaatatatttatttctgcatggatatgctagagagaaaactagtttatagctagtgagacaatgtttaaacttatttcgctataaatgaaaaatcgcttgtactactttcagtaattgattttaaatgccattcaggttatcaaaccagatattttcaaatgatgataagtagaaaatagtttaatgccaactgatgtggaagttgcttatttgtgttaattaatgaggagaggtctggtccatgaaaatattgtattacaaacagtggcattgtcaatgaggctgttagtttactcaagagtgtagtatggtgaaagttacatgttaaatatcaattactgaaaaatggaacatctttgaaaaggaattttgcactatagaaaacgtcgcaggaactctaagagcaattctaagagcaatttaaagaaggtttttctataatataataagcttatttatataacagggaatatatcagaaaatgatttattctgcctgctcaaagatctcctttggggtaataaagtataatcttctggtattagctgctattaatacataggccagttgaattatatcctaggcagaatagccctacatgcaattgaaaaatgttgtccaggtgatttttggtatgcttttaatatttgagtcatcagccatccattgtctaaagtaaaataaatatatcaaataaaaacgtgtacttcattcatctcattaggttgtcagcatttacagttagagagtatttctgaaagtattgtatttcagttcagaggaaatacactataaattataaaattgctgacacagtatctaattcttttccactgtgatgcctactagacccaaataaaccaaagaaaagtataaatagtactttattatacatcttgtgtggggaccgcatcatgctgcctataacagaatgaccaaattggttttgtgacggtcagttttgttttgctttttaattagcaagtttatttttatgttttatagattttgtcgtaaatacagcctaattaacacctataaactgtgacatatctagactatgcaatattgtttactgaaaaagagatgaactatcaaggcatgaaaacacatggatgaaatgtatgtgcatattagtaagtgaaaaaagccaatttgaaaagtctgcatactggatgattccaactatatggcattctgggaaatgcaaaattgtggagacagtaaaaaaatttagcatttgctcgggattaggatggaagaagggatgaactcgtggaacacacagaattttggggggcaatgaaactatgctgtgtgataccgtaatcatgaagatgaatcattatatactcatcataactcacggaatatacaacatcaagagtaaaccctagtgtaaattatggactctgggtgacaatggcgtgttgatatacgtttattgattgtaacatgagtaccactctggtaggggatattgatagtggagaggctgtgtgtgtgtggaggcagaggtatgtgagtactctctgtaacttccactctattttgctgtgaacctaaaagtgctctaaatgtgtctatttttaaaacataaaataaaaataaaaaacctgaattttatattcgtaatcttcatacttttagtctcaccaccttaagtattttactgtttgccacttaccaaaatggtggtgcaattgaagaatggtacgtgattcctctatgttgtatcatagtaaagtcatgcttgcatttttttctttcttattgtagtagaaaagccatggatttcagaatctgtaagatcttagttccaattctagttatactagctgtgtataaacttatttcggtataaataaaaaatcgcttgtactactgtcagtaattgattttaaatgccatccaaacctgaaggatagaaaatatccttttaaggttataaatctatccaaacctgaaggatagataatatccttttaaggttatagtgaacattaagtaagaaatattttgaagtagtttaaaatactaataaatattaagtatacttttaatactcatatatattttccttttcaatcaatacttgtttttcgatgttcacaaagcttttgttaaaagggcaatgttttaaaaatatttctgtagagctgtagtttatcattgtgtgaatcatattacaacactagagtctcctagctcatagctaggagctagttagttcgtaactgtgtgaagaagataaatcttttgaaacgacaaagtcacgactcactcatcttaaaaggtatctcattatcctagaacaaacttggcatcattgtattactgacttccaagagaaaccaatcccattttgcctgtattgtctttcctcttaccggcattttttaataaatgctgttgacacagtagcttgctttctcacagttcagttttcctaactgtttgattccatggcaaatccataatcctattttaaatattctccaggccatgaaaatgaatgctatttatatcaattcggctgttcaactgcagtgcagaaaaagcttttgtatccagagatacaagcctctggttcaagcataaattactgggatacactgctcttttttcttttaagctgaactctccttgacacgaatccccataggtgtcttaggtaataactgatattccaagaaaaaaaattgtgaaaaacagttaaaggaaaagacaatttacatttttaatctgatagatcatgtttccaaaatgaaatctctcttaactctggtaatcaattaattcatacatatttccatcaatagatctttgaatagtggcttaattggtcttttggaaatgaatcatttgcaaaggtagagtcgtgcttcatgtactagctccctgaaaggtagtgtgcagaaagattaaatcgcaaagtggattgtaatcaggcagatcttggttcagattgtgactgtttcctacttaaactttcagttttaaaattgaacttggcagagcttattttatgaagtatgaataatatttacttcttgagtaaataaatcttgaggttgatttaaatgttaagtaatataatatatgtaaagcactatgcagaatctggtatgtagtgaaagctaaatttgagttattattatatgcaggactatcttaagtttgacacactagctgtatttttctaaactgtataaatcacttcgactaagtcaactagtatatttctatgacgtactcataaaaccaaaaagattaatcatttcttggaaagcttatgaacttataatatgcagtcctaattgaaccatgacctacaacagagttttccataccaatgtaatgtttcttggccttgttgcaccgaatggaacataagctccgtggggacagagattacatttattttggtctttgtattttgcaagttacctcatttatgaacttgcacataattagtattcaatagttacataattagtattcaatagtcatttataaactgacaacatataaaagtaaatacaggttatcaactgacactcttatttatcttattttaaaaaactttattatgataatctttttaaaaatagttattgtggtgcctgtatcaaagatattaacagaaatttgttaaataaatgaatgtagttaattttcatttacagagcatgaatgccagaatttggataacttctgtactttccttgtgttcaaattctggcaggactaaaatatgtctgtttttcctttcttccaataatatctcatgccatgtttatataattaatacagtagattattatccataaattacatatatgcaaattcaactacatgctaaagttaacttgtgccccacaaatctactcctgggtctttcacagtcattcatagacatatgcagaataacagaacaattgagttgcttgttgtctactttcccagctaaggttgaacgaggtgacactgtgccttcctgtttcagctcttttactgtaaacaattatcgttttgagggtctacttagtgacatgtttttcacatttttgtgctttctgttggtcatgttcctgtttaaaatcacttcccaccagtcacttctgcccccaagcatagtgatgaagagttgtcctgtcttccttagtgcaagaatgctgtgatgtgccttatggagcaaacacatgtgttagataagcctcattcaagcgtgagttatagtgttgttggctatgagttcaatgttaatgaatcatttaaaataaggtgtctttaaacagaaacaaatatgaagtaggttataggttaaagggttcatgaaaatgttgtgaccagaggctcacaggaacctgatcctgtatttctcctaggagcaatgattcagtagttgctaattcagtgtttatgctgagaatacaggtaaaaacaactgcaaacaatgaaaattgtctataccacttgtagtagtcaactcttagtaatcaaactcttcttagggttcacagtataatatagagatgatgggtaccagattggattacatgatcttttgatgttttctgagtctcctaatacttttcttgatgggattgaatgattggatatcttaaggccagcttccagaaataagctgatcaagttttgatatggtatattggaattctgtccactcccactgccttttccataactattcacactctaataagtagtggaacatcatttgcagagatgggatgaataggtaatttttggctatgaaatttgcttgtccccataggtctctcagatgctcagtttggctttcactgtgcagcagccaatcattacaggaaaaactgttactcttcctaatcttaagtaactttgattttaccctctcgtcatgaaataagacctacttagccgtatggaaggggagtttaagataaaggaaattgaggaatgttaaaaaagagtagaaatgttatccaaggaaggagagagaaagagatgcagattagcacagggtgaatttagaccagaatgccttaatacagatgttcagtaaagctaaatctaattctcattgaaaatcccccctccctttaaaatatctccaacactatgtcaagaaagagagaaagagagatagaaatttcttcttccaaccttgttcaagattttgccctcccccatattctttattctgttgtgggcaaggaatgtgatttttcttattgaaagttaaaaaacaggaagtatttgagatctgctgggaacacacacacatgcataaaaagatagtgaatttggaggaaagtgttctaaactcagagtaaagggctaggttctaattatctgcagatggcaaattgctggctttgtaggatggatggatggatagatagatagatagatagatagatagatagatagatagatatggatgaggcccaagcctatatgttactgcattctgctgtgggtttgcagacaagtctagtttaacttctttattgcagtcttcacctcaacacacttactgcaagagacaatattgttatcaggctaagaactacagaacagaaggtggatttatatattcccttctccaatcacaccatttgaagacatataagtcctctggatttacaattagagaacgaccagcaacctctataaaaaatagtgcagaaagagaccaagattcaataattatacacagttgttaggtctcagtgtctgctttgcctaaaatgataatgcccagcaactttttctctttagatgtgtgcctaaaagccaggtacagtgtggtaggtgactcaaagataggatgaataccctctttccccccacgatatcatgacatatttgtcttctttgaagaccaagaactcacttggcagtttgctttggcagcagagctttctgagagagagagaaaaagagagagagagagagagagaaaatattgacagaagtggtcacatttctcatctttttgtcagctctggtagtaaattcaagatttaaatttgtagtaagtatggaactttatagaacacaaagtaaatgtcaaagtagacaccaggaaaaattatttttgcttctacagccctatcacaaaggcaatctcagatttaatagttattccaaaaggagcgggagcataaagcttcattgtaaaacacaatactctaacaaatggtggaaggcttgcaatttcattgcaaagagagaacatagcacttctttgccaaatatgtggcaaatcatatttaattgaagctattattccagtgagaagaaataacaatttgacttctagggagttttaattgacagtattataatatttgtgcaatgtacatccactacaagaataaaagaagcttttacaattgcatactgaaaaatgaaagtatcaataaaatttctgtaaatcctggaaataataatatcacaatatagctagctaaagaacaattttcttcactagattcacatagcttagagaaaaataattttcacagaaatatactcatcatctctttccctaacccatcttttgtaattttcctaatttcctctgtattccactatttcatcatctcattattaagaagcaaaacatagaggcatttttgcattatgcactacagtcttttgtttgaaatttaatgggtcatgagttctgcagtccttgggaagatagtctttaaaaaaatggggatttttagatattacatacttgtagccatctgcttaatatgtcattttcaaccattactatgaaggtgtggagagtgttatctcacttcaacttcaccaacaaacacttcaacatgcattagtttttttcctatcagaaccatcactcaagaaataccagttgaatgcatataaacatggcactgtgctaggtaatgtggaggatgcaaaggtaatagacacctgtatctgacaacattctagtaggaaaaggagacttacacaaaatgtttatatagtttcactacagagtgagatgtgtcctaagagtcatgcaggaaactgtgcgagatggatttcagtagaagaaatcaatatgagctccatacgggggctttattataaggggtagaattctcacctcagttaaggtagaatgtccttgggggaaaagcaaaaaaagttcaggacacacagggagaatccatctaatttgaagtatagacgatgtaaagagagggagtgggtgataagtttagaaaaacatgtaaaagccaaaataacaaaattatttaacatcagatgaggcagtttgaactttattttacaggcaatagggcattagtgaaaattttgaacaagaaagtaacataatcacaattatactcaggatagagtggattaaataagcaatggaattgatattagaaagaaaaattaggcataaggcacagagagggtgataaacttctgagctagaatgttttatattttcatttctgcctaacaccaattcttggattacctggatgttactaagaatatatatacatatattcacattaagataaagctatgatcaataatgtttcttttttaatttcagatttttcattattcgtatactgcttcatatgtgatttacaacatacacactaggtaagttctttgattttctagttttcatgagcaattgtgttactaaattgttggtgtagatatcagtttgttcatgtaaaaatattcacattttttcaagggaagtttgggagttaaatcctccagaagtagaggactccgtcttgcagtacgcggcctggggtgtccaagggcagcagctggtaagcgcaggcattggtatgcactgaacactgccaatcatggttttatggaagatgttaactgaaactttggaaaaaccataggaaaacttgtcctacaaaactttatgtttccctaagtcctttatatcttttatctaatagtccaacttaagaatacattaaatgatactagtattattttatcagttaataaagacaaaagtttattaagtaatatatgattaaactgctggtttataatgaaacctagaagagattcaaggttactaggaccttgtactgcatactttccattacataatattgtcagttttcatgaaaaattcaaaataaagattattttttcttaaagcattgttcagggtaaaaatttagacagaattatttaatattctcttaagagaggatttttacttttatttttattttgaaattattacaaactcaaaaagataattattgatatataaagcagtttgagcaattatatatatatgtatgtgcatgtttattttaggcaaagtcttgctctgtcatccaggctggagtgagatctcagctcgctgcaacctctgcctcccaggtttaagcaattcttgtgcttcagcctcctgagtacttgggattacaggcacatgctaccaggtctggctagcttttatatttttagtagagacggggttttaccatgttggccaggctgatctcaaactcctgacctcaagcgatccacccacctaggcctacccaaagtgatgggattacagacatgagccagtgagccccgcctgcaatattatattcttgtacatatctcatggtgacaatgtaaagcctttctcaagggaatattgctcagggagtagtattgcttactatcctgtgcatgctcagatgtactgagcatcaccaaactgatttctaggttatttgttaagcgtgtttacacctaccagcaataatgagagcgttcccttggttccatatccttgccaacacctgtttttccagacttttaaataattactcaaatgatgatacaaaatagtatttcgttatagttttattaacatttagtatttccttgaattctaataagctagagcaacttttcatatggttactggcaatttgtattttttcatatgtgaaatatctattcatatatttgtccattcacattttttattcttttttttttagttaaaaggaaccccttatatgttctggatattaatacattgtttggtctatcttcatccagttttcggatttacttctcactctcttaatggatccatttctacaaacatatttttttataaatgtagtctgatttatcaaatacatgatttgtactttttgttattgatgaaatctttacaatgaaatcatacttctctagaatttttcaagtgggccttccatgtataggttcttgatccatccatctgaaattgctttttttggtatggtattaagtccctatccatttttatatatgttttatatggccaacaattgtcctgaaaccttttgttgaccacttcattctttaactattcatctgcagtgttacagtgttatgctgtacatatccatgagtcttcttccggctctttttttcttccaggtggtttgtctattagtgtgctaagacaacagtatcttaattaaaataagctttactagctgacaaggcagtttcatatgctgactttgactcttcttgactttttagcctttcatatgaatgtcacaattgtctttcatgttacatgcccattttcagaattttgaatttattatttgaatctatatgtctattttgggaaattaacatcttagtgatactgaatcttcatatctacaaacatttaatgtatgtatttagttatttaagactcttaatatctcaaattttacaattttatatctaaaaatttacactttatcattttggtgactcttttaagtgcttgcatttcttattttaaaaatgtttgctactggtaaatagaaaggtactcaaattatttatttaatatatatcaaccttgctacgcacaattatatattccaaataattctgtgtagactattatgctttttgttaataatgacatttttcttttccatttcaatttttataatttctatgtcgttaaaatccttctgcactagttaacctatgaatgtaactaggtatggtggggttttttgttttttgtttttgctggaatactaaaaaattgattctattatggttactgggttaagttttacaattttttttttagttagttttagttagtgactgcaattgatgagacatgctttatggcttgggattttttcaaaatgctttttatgtgatggataattttatatatgttctatatgacaggaacaatgttctatatgtgcctacaggatcaatcttaataattatgtttctaagagttatattttcttactaatgacagtggatatgtgatttttttctttagttgtcagttttgcattatataatttgaactatgttgtaaagaatgaggaagttataaaatgataaatacatctttctattgaattcaaatgttttataccttaataaatatatttaccttatttacctttaataactctgattggccaaccctcatcctatcctttaactagttcttttaacgtagtttagaatcctctaggcttttttaaaatttgaattgctgttttaacaacagctggttgggctgagttaagtttttaatttcctgcaagcctcaattttctcatctataaatagaaatatgtacaccatcatatcattgtgataattattttggaaaatgactatttttcataataagatgcacattactatgatttatatcctattttataaatctgtatatttcttaagcttattagtgaaatagggtaattataatagatatttcatatcatgagaagcctacagaataatacactgtggctaaataaggtttcctttcattggaaaataatctggaccctcaaatattcaaagaaatcctacaaacaaccctgcattcactgtcctttccacactaaatggttgaataattgagtaaatcattatgatgaaaaaaggttagtgatttaaaatgaaaaatgtctgcaattgtccagataccacagattatagacattatatttgcttttatcttgtagatatttagataaattaacaaacaatgcatttaatctaccatcacagaactctctgtaatctatcccactatgatatttctgaaaagtggcagcaaaatttgcatagaatatggtaaatatgaatgtgcagggtttggtctagataaggcatgtaatcaatgaaacattcatggacaatggtgagtggacaccaagaagtggcaggtgctctcatccttcctgtttcactctgatgttgtgaacaatagagctggtccattgggccagaagcaactttggaacaaaccaaattccagaacacagaaacccaagacaactccaccttttgtacaaaatactgcccagtattttagaaaaaaatggacagtattttggaaaatcttttacactttggttggttttaaatgaccctcttattcttcatacttgagggaaaccaacacctatgacaaaataatagcactttgatacactcagggaaatagtattaatgtatgcattttctttatttgttattgattccttattttttaatatatttaagaaaattatgaaaatactaaaaatgtataaaaattataggttccctgtttgaagccatattgcaggtgattacattctggttctactgcttactagctgttgatcttgagaacattatttaatcttgatatggcttactgtttccatctttaaaatggtagtgctttatcaatagtgctattctggtgtttaatgtatgaaatacagttctaaagcactttgaatagtatctggcctataataagtattttgtaggtattcacttttactattattaaaaaatctgttttcatatgaatttaaacaccttagggaactttagggtgactagttttgtggagaattaagcttaagttttctgtaatgtcatttttcaaactcctttggggaattcttaagagaaatttcatatttatctagtttatcttttgagtgcatgcaaacataaatttaaaaaagtaaaagacatacttctacaaatggccaatggtccatttcatatgagtttggcatgctttgtcaatatttgaagctattagcaaactcagcaatatgattttattagagatgagtcattacaatactttaattagttttgcattaaataaagaggcttgtagtgtttactaactaaggataattaattatccttcattttcagcttctaatcttatttgctgtaaaagaaattcctggtattatagaagagaggcaagggattgacataatttactgaggaagaggatctaagttagaactcagaatattgaggagaactttcaatagcactaagtgtgagtaaaggcaatttagatgtgtcaaaatttgtggaaaaatgaacctgaagcaataaagagtgcattatttggagaaggtggtgagtgaaccactttagctgtaataaagttttattgaatagaaatggtttgggaagaggaatctgggaattatggtagaaagagaagcaccaggaatctgtttttccattcagataacaattgctacagtagacatgtaactattgagaactctagtctattgaaagtgtgtaaattttatgggaaggcttgaatggaagtttgtggttaattttagttgacttgaactcttagctcagaagcagctacctatcttcgaccccagccccatggcaggcagctgtgcttatgttcctggagcatgcattcatcttgcaggaaccaggatggacaatgagggccctgtgatgcaaataagtaaggatttgtattcttattgtttattgccccttctcattatgaaattgcagatatagaggaaggcagctattgtttcacatccttacacccttataacaagctcctctccctccagctgaagtgaattctaaggtggttaaaaggccagtgccctttcctactcttcatttttctcttttttgagggatgtcagccattaaaaattaagatattcaaaggcaactgaatgtatgggagaaattagcaagtcaccatacatgcacagggaaagatgcaggcttacaaaagatctgagaagacttttttcacataaggctgattctcagcataaagacagcctccaacaattacaaaagaaccaacataacaaaacaaaagcaaaaacataaaatagaaaaccatgggaaatgggaatgtattagtccgttctcatgcagctaataaagacatgcctgagactgggtaatttataaaggaaataggtttaatggactcacagttccacatggctggggaggcctcaaaatcatggtgggaggcaaaggaagagcaaagtcacgtcttacatggcagtgggcaggagggcatgtgcaagagaactcccctttataaaaccatcagatctcatgagacttattcactatcatgagaacagcttgagaaaaacctgcccccatgattcaattacctcccaccaagtccctaccatgacatgtgggaattattaaaattcaaggtgcaatttcagtggggacacagagccagattatatcaggggagattctgatttccagagataccaaaattattagattcaaattgtctggttttcaacaataaaaaaattacaaagaatacaaagcaataaggaagtatggcccactcaaagggataaaagacccaacatcaagaaataatggaagtcatggaaaatatgaagaacatgatgtatgaacaaaatggaaataccagtggagagagagagagtaaacctaaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggagaaattaagacattctcagataaagaaaaattgacaagagttaccactagacctgccctgcaagaattactagtgggagtccagcaggttgaaatgaaagtacactaggcagtgatttgaagccttataaagaaataaagatcccggtaaatgtaaatacatgggcaattatagaaatgtatgttattgttacaatgatttgtaactgcactttttcttttctacttaatttaaaaagctaagatatttaaaatttttagtctaaaagctaatattattttaactttaatttgtatttcacattttttttagacataatttaagaaagtaatgccttaaatgtcattagttaatacctttggatgtacaatatacaaatatgtaattttgtgacttcaataattgagggaggtgaggatgaaactatgaatgagcaacgtttttgaatgttattgaggttaagcttgtataaattcaaatcagcactataactttatgatgttgcatggaaccgccatggtaacaacaaagaaaataataaatatacacaaaagaaaggaaatgagaatggaattaaaacattctactattaaaaattaaactcaaataagacagtaatgtggaaaatgagggtaacaaaagataagggatatagaaaagaaatagaaaaatcacaaaagtaagttattccttatcagtaattactttaaatataaatagattaaattattcaattaaaagaaactaagaagataagttttaaaatataatatgattcaactacatacgctctataagaaactcactgtagatacaaagacacaaataagctgaaaataaaagaatggaaagagatatttcatgcaaacagtaagcaaaataaaataggggttgctatactaacgtaaaaataggcgttaaatcataaacagttttgagagacaaataaatcaatacagtaagaagatataacatttcaaacatttatatacctaataacagaccatcaaaatatataaagctaaaaatgaatataattgaagggaatatatatatatatatatttctaccataattgttggtgatttcaacaccatactctcaataatggctagaaaaaccagagagaagataattaagaaaatagaggatttaaaaaacacagtaaggccaggtgcagtggctgacgcctgtaatcccagcactttaggaggctgaggcgggcggatcacgaggtcgggagatcgagaccatcctggctaacacggtgaaaccccgcctccactaaaaatacaaaaaattagccgggcgtggtggcgggcgcctgtagtcccagttactctgaaggctgaggcagaatggcatgaacccgggaggcagagcttgcagtgagccgagatgtgccactgcactccagcttgggcgagagagcgagactccatcttaaaacaaataaataaacaaataaaaaacacaataagccaactagacttagcagatgtatacagaacactcaacctaacaacagcgtacacgttctttcacgggcgtttgagaaattcttcaggatggatcatacattttgccacctattaagtctcaatagcttttaaaaaattatcacacaaaagatcttctctgatcacaatgggataaagttagaaatcaataacaaactgaaaactgaaaaatttctacatttgtggaaattagaaaacattctctcaaccagtgagttaaaaaattacagaaaaattagaaaatacttagagatgaagtaaaatgaaagcacaacataccaaaatgtatgagatgcagcaaaaacagtgtaagcgggaagtagctatatatacttactgctgtggaattaatggtgttcccacaaaatttatgttgaagccctaacctccaatgagactttgttagtttgttggagataaaagttttaggaggtaattaagtttgtacaagatcatgtgtgacgctttaatccaacaggactggtggcttaaaaaacagaggaagatctctcactctttctcttgctcttgctgtcactctctttcactcttgctctttgtctctctgtgcatactcaaaggaaaagtcatgtgagggcaaagctgccatctgtaagccagtaggagagctcttaccaaaaactgaaacatgttggaaccctgatcttggattctttagcctccagcactgtaaataaatatatttctgttataaactgcactgtctttggtattttgttatggaaggctgaaaggattaagacactcacattagaaaacaaaaaaagatctcaaatcaacaacctaattttacaactgaaggtactcaaaaaagaaaaacaaactaaacctaaagatagtagatataaacaaagtagataattaaaaacagagaaaatcactaaaatcaaaagttggttcttcaaaaaaatcaactaaattggcaaacctttagttagcttgactgaaaaaaaaaaaaacaaaaaaaaaaaaacaagagaagactcaaattcctaaaatcagattgaaagtggggatattatgaccgtttctacacaaataaaaaggattataatagtactatgaacaattgtataccaataaactggataacctagacgaaatgaagatagtaccaaaaatgcaaaacttcgtagtagagtcatgaagaaatagaaaatctgaataggcttatagttaatatggatattaatgcagtaatcaaaaacctcctggccaaaaacattctggaactgatggcttcatgggtgaattctactaaacatttttaagaaaacctaacaccaaggccaaggcgggcggatcacctgaggtcaggagtttgagaccagcctggccaacatggtgaaaccctgtctctactaaaaatacaaagattagctggatgtgttggcaggcacctgtaatcctagctactcaggaggctgaggcaagagaattgcttgaacctgggaggcagaggttgcagtgagttgtgatttgagatcatgccactgcactcctgcctgggcaacagagtgagactttgtctcaaaaagaaaaacaaacaaaccaatatttctcaaacttttccaaaaagtcaaagaggagaaagcacttcttaacccattatctgccagcattatcctgatacaaaaatctatacatgctacaaaaaacttacagatcaatttttcttatgaacatttatgtaaaaattctcaacaaaatactaatacaacaaattcaactgtgtaaaagattatacaacatagctaactgggattcattcttgaaatgtaaggatcattcaatatataaaaaactgatcaatgtaattgtattagtcccttctcacatcgctataaagaaatatctgaggatgggtaatttataaagaaaagaggtttaattggctcacagttctgtaggttgtacagaaaacatggctgggaaggcctcaggaaacttttactcatggcagatgggaaagctggagcaggcatcttcatgtggctagagcagaggaagggggtgagagttaccacacacttttaaacaaacagatcttgtgagaactcactcattatcctgagaaaagcacaaaagtgatggtactaaaccattcatgagaaacccactgccatgatttaatcatctcccagcaggcccctcctccaactttggggaacacatttaacatgagatttgagtgaggacacagattcaaatcatgtcagtagtatactacattaatgaaattaaagaaaaaaaacacataatcatctcaactcatacagaataagcatttttaaaaatttaacacccttatatgactaaaaaaaaacaacaaactagaaataggagaaaagtacctcaacataataaatgtcatcatgtatgcaaaatgaacggtgatcattatacttaatggtcaaagactgaaaatagtttctttgagataagaaacaaggcaaggatccttccttttgaaacttgtattcaccacagtactggaagtcctagcaaaagcaattaagcaaacaaaaaaataaaatcaattcaaatggaaagaaaaataaaattatttccatttacagattatataattttatttctttaaaagcctagagtccacacacacactcagcattttagaactaataaacacattcagcaaagtactaggataaaaagtcaacacagagaaatcatatacatttgtaagtctatacaataactgtgggcaatctgaaaggaaattaagaaaataattttatttacaatagcatgaagaaggatagaatgctaagaaattaactcagtcaaatagatgaaagactcatacaatgaaaactaaaaaatatgtctgaaaaaaattaaaggacacataataaatgtaaaggcataccatgttcatgaattggaagatgtaatcttgttatgatgtcaatatgcccaacacaatctacagattcaattcaatccctatcaaaatccaaataatgtcttttttgcagatatagaaaagcctatcctagaattcgtatgaaatttcatagggcttcaagtatccgaaacatttgtaaaaaagaagaaagttggagaactcacactactgattcaaaacttactacaatgtatagaattcaaaatagtgtgacataaattaactgtgctggtacaaagacagtaatatagaccaatggaaaagaagagagagtccaaaaataaactttcgcatttatgatcaaatgaaggtgccaaatcattgaatcaggaaaggactatcttttttaaacaactgatactggaaaaactggatatccacatacacaaaaaataaactcttacctaatatcacattcaaaacttaactcagattggatcaaatatctcagcataagctctaaaactataaaacttttagaagaaaatataagtcagaagtttgaagatattggaaggaataaatgaattgaatcattttgcagtgctttcttggatatgacacaaaagacacatgaaattaaaaattgacaaattagattttatcaaaacttaaaacttttgtgcatcaagaacactatcattggagtaaaaaggcaacatgtggaatagaaaatatttccaaatcacttatctaagaagaggttaatatagaggaataaagtatacaggagttcttatatagagggattctaaaacgtaataaaaagaaagcaacctgattaattccaaaatgggcaatgaacctagatatcaaaaaatatgtaaatggccaataagttcatcaaaatagcaattcctatggaaagaagtttgatcttaatatgaagtggaaccttaggaattaaccattttcggtaggtaaacacaactgaatatagatgccttgatataattccatcgcagtaagtagcaaagtgtaagttaaagtgagctaacatttcatgcctatataatcatcaaaagtttaagtttgataataccatttactagtgagaataccatttactagtacacaatagggacatgtatatcctgccaaaggactactagtgacacaatgaccttgaggaacaaggttaatttccttgttcctcaaggttaagttccttgttcttcaaggtcaagtttgtagaacttagtcgtgttgaagaagtccatctctaaccctcagagagtgctggtgggcatttaaaatggtacagcctctttggaaaacagtctggtatctcctcaaacaattaaacagaaagttatcatatgatccagcaattccattcctaggtatatgcctaaaagttcccacaaactttgtacgcaaatgtccacagtagaattattcatagtaaccaaaaggtgaggaaaaacacaaatgtctgccaacaaatgaatggataaacaaaatgtggtatattcaaacaatgaaattattattcatacaatgaaattattcagccacaagaagaaatgaagcactgatacgtgctacagcttggatgaaccttaaaaacatgctaagtgaaaggagccagtcttctttcagaagtcaaatatgatttcatttatgtgaaagtccagaatgaggaagtttgcaggacagaaaggagattagtggttacttacagttggaaggattgagggatcagggagtgatagctaaagtatatgggacttctttttgagataatgcaaattttataaaattgactgtgataatagctgcacacatctgtgcatacaatacaaactataaatctgtaatttttaatgggtgacttgtttggtatgtgaagaataggtgtttttctaaagaaagaactggtaagtcctacaacagtaagttaggcattcagttgaaaaggcttgtggtgcaagaaggtgtgtcatttttctttttaaacaaatgtagccttataaaggtcagaattactcattgtagaacgttttgaaattgatataattaataaaaacagaaagtatacttatctataattgtatcacgaagaatggaataatttcaaaaatcaggtgaagggatttcacctttagaaggaaaaacatagtactaattagaatgaatctagaatcaagaagctcaagtccagattattttccattcttttccttactcattttttaaatttatttattattattattattttgctttgtgatttagggagagttgaaggctgtacgcttaaatttacttacattacaaatgaaagatggtcataactagttccagttttgtttaagttttaactgaggtatgtcaagtgtatcagttaaaattctccagaaaaacaaaaccaataggatatatatctccatatatatagggagagggagaaggattttaacgaattaactcatgcaactgtgagggctgacaagtttgaagtctatggagcagaccagcaggctggacaagtattaatgaattgatgtttcagtcttgagtcctaaatctgtcgggcaggttggcagttgggaaagttaggcacaatttcttgaagcagaattcatttttggggggaaacttcatattgtacccttaaggccttcagctgattggctaaggaccatccatattattgagaatattcttctacttaaaatgaattgattgtaaatgttgatcacatcgactaaatacctccacagcaacgtctagactagtgttttaccaaacaaatgggcactatggcctaaccaagttaacacaagaaattaaccatcacagtaggtatgacacttcacacagtgagaactcaagaaataatagctattattttgttcccacctgttctttcctacaaataattcacttaattcagagcctcatcatctttcacctagatattttagtagcttattttctaaaatttgttctcacatctccagtcattctaattcagccaccatccgcagaaatatatgttaaaattgaatgtacttaacagactcccacaaggttataaaatgtcattgaagtgacactcaatgtcattaatgtaactaatgtgacaactggtccatcatctgagctcctgccactccagcacagagcacatatttttctctacctgaaccaaactctttgtgatttctggatgaaagacacctgactcctctgtgtctctgagtcattcctcttggtagacctagccatttaaaaaaaaaaaatttccttcaaaagtctttgttaaatactttctctcttcttctctgataatttttttctaacccttactccatgctaagtgaatagttcgctttttgggattctggcattcctctctctcaaataatttttaatactatttatttatgttgttatcttctaccactaactgagggggaacacctagaatacaggatctattaaacattttttctctctcatttgtttttctcctcctccatttcttcctcctccttttttgtaaaatttactgtagctcaaggcaaaatgtaagtttaataaatttctggttgctttgagaaactgatgaaagacttattgttatttctgtgtaaaacaagaaaccaaaggttttgaggattgtataatatgggaaaaagtcatgtatgagaagatagatcttgtaaaggaggccatgatataccataagctattgaatctggaagcagggagctaggtgtagaggccatcattataatctggaactgcaatgataatcaaccatatatcaatataacaagcttttatgctgagatctaaaatttgattgctattcaaagataaaaattatcttataaacctaattaatgtaaatgaaatgaggcaaatattaaagaagtgtatttctaaaggtttctttttctttttacaaaaatgtcctctttgagactccttccctgaaattgctaatatttgtttaattttttatattgttgaaaaatgtaatgtttaggtaattcttcaaatacaaacaaaaattatccacatctctctatcacctgtgtttttgctattactaggaatttatcttaaaattttattaaaacctcaaattatgagcaatggtttagtttctttgggagactttaaatttgtgatataatctcttacttcattactaataacaattgtgaactatttgatcaatttttcccgagtagtatttaaggtagcacttttcaaacatatctttgaaatctcacatttcctactaaaagtcaatgagattttgcttcatattccattaaatatctatgctttttaatacaaaagtaattatttttaatctcatcaggatgtgttcaagaaatgtatgataagcatacacaaatatatttgtgtgtttgtatgcacacacacacattcacacacgttactgctggtgccaagcacgttctgggctgaaagtcttggccttagagtcctattataccagagctttaatggaagtagatgaggaacaaggccagcaattgacgaattctatttcaagttagttatttaactgtagtttgtatgatgctcatttctagttggtagaatgatgcagggaaaccactagggagtgaagccaaacaatttacactattaatatcaagtgtttgacatgatgagtgtttccaatataaataaatttggaccacttttttgttgttgtttacctcattcatcttcattagtgaagataactgaaatccgattaccttttcattttatctgaaacaaaatcgaatgttcctgcttttagttgcagggtataaaaacaatctcccttaccacattgtagtattgccccatatctaacgtctaatgggtctcaaatcaaatttgagatcaggaaaatcaataccaagcagctcatatcatttatttactaaatatttgggccagaaatagtaataaactgtaaggggataagtctgtttgggtttaatgggggggaaaaaaacaggaaacaaaacctcacctttaaattatcttaactatcttcacttataaatttgcaatgtatttaggtatatatttacatgaatatattacatatgtaaatgtaacaggaaatacaatgtcacataaataaaatgccttaacattgtgcaggtatgtgggacaaatatgcaattatgttatataatttaaaggaaaattaatttgcattgctgtgtaaaaatcacctacacatcaggtgagcaatcccacaaacttcctttaattcatatttaggcaatattttagtcatttagaaataataaggtatttgtaatgactttatcttttttctcttgttttccaatgtaaatcacaatttctgtggcacgtcttgtttcatcctgctcataacataatattaaatattaaattgtggagtaagaaccatcaaaatcatgggattgtagattttctaactgttcacctgggtcatgcataatctaatatacacaatgtatactttagacagttcctgctaaggaaactatttgaatgaaagagcaatgtagatgacagttagtgaaagttcctgaatattagactctttctgtatcattgcaactaagcgcttacaccatacctattattcttacatttgatcagacagggttaacctagagtgatatgtcaagtttcatttgatcagcagtctaaacaaaaacttaagaaaaatgataagattataatagtatctaccacaagatgtgaaccatcttacataacccctgaggttaaaagatcccaattaggcagagttcagtactttagtgatttactgtgttttattaaatggcatgcagataactccccaaagggaactgtggtctgcattaatgtcgagactcttcatgtcagaaataacttcagacatctttcaagtggtgtggtagaggagctctccgcttgctctcctccttaagaacaaccaaagaaatgaaaataaaaaaagacagtacaatttttatgttacattaatcagctacagcctaatctataatctcaacggaacatagagtaaaaagaaatccacagccagaaaaggattgaaagcaaatatacactttaatagattttgagaaacacaaagaaatagacaaactgacaattttagctggtaatttcaacatttctcttacagtaaaacatgaaaaaagtagataggaaatcagtagggtataaaaggtttgattaacactatcaaccaaattgacataatcgacttttatagaacactatatgtgataattacagaatacttgacatgtttaagtgcacacactgggccataaaacaagtatcaataaatataaaagaattgaattcataccaaattatattctatgaccataaaggaattaagtaagaaacaaacaaattttacacacacacacacacacacacacacacacacacacacacactctctccacattttttattggaatacgaatatatctaataagtaatatagtattatacatctagtgattctgaatgtagattttgtcctgtaaatatattacacatgtgtctcaagacatacattgagaaaattcattgcaacactatttataattttaaaaacaaaatagaagactgaacacaacttaaattattattatgggactagtaaaataaactatggtacataaaataataaaatagtgacttcttcagaagccattaaaattaatgattcttctatatgtgcaggaaagcagtgctatccagtgataaaagaaaggtccatattgttacttagcatgttattattacaataggtaaaacattcccccaaaacaaaaatatctatatattatttaaatatttccagaattatgaataacaagatgaaacttaaattacagaattgattacttttaacatagcatatgaaaattaaagcacatcaggaacttccaaagtaaagaaaaaggtggcaaattgttatatatatggatatagatatagatgcagatatcttattttctgaagtgtatgtcagcagcaatgatcacatacaatggcatgagattctacgtgtgttacacgtgtcaaacataatcagagacaaaatagggaaagcaatatgttaaagtaaaaataattattgttttagagtagtagaataatgttggtatggtctttaacgtttatgttattatgttacatattgttttaagtgttagaagaggaactagaatatgaggagcaagggacataaaggactagacatttaaagctgaatttaaaaagcaactgtgacttggaccttaattctacttggtaaaaaagacttgctaataatattgaagttggctattaaaagaccgtggtaagtatcttatttgtttctgatgtgctctggaatggaagtagaatgcaaagatcattatattacaaattggtactcaactcttaattctttcaaaattatcctaatcactgtttctaacatcccagaactaaactgggatatgggggtgaataatgtcaagttggctgttcatttaagaaaaacaaagcttgtccactaacttttttgatttcccttatgttattcaaattcagtatcttccaaaagagctttttttggggaaaattttcaccatcttctaaccaattttatatctctaacataaaaacctgtccctgaaagcataatgacatttgtaaacatactaataattcagatctttacacttattcttggaattagaatcaaaactagatataaaccacttcaccctttaaaattatataatttacttgacattaataaattcttcttgaaaaggaaaaataaaaatactacacctggatatgatgaagaatgtactggaaaataacctttcacttcagagcaatcacaatgaaaagaactttgactaaaattgaataaatggttttacaaccctgatatagaagagcaattgctcacacatcaatcttcacgcaaattcagcaataaactctgacaaaaccttaaaacaaaccaacacataaaaagctacccaaggactcaagcctgaacaaaaccaggcagattttcgaagggagtgaaatttacaggaaaatagctcacaaaataggattcctccattttgttagttttgtttagagttttagcctaagggcaactgtagtggaggcagagtgtgggtatcaagtaagttgaatctctgataggaaatccgactgtcgtttaggcaagaccaagagaaagagcccttgagtagctgtaactgccagagaatgagaagaatccctgagagagtcagagcaggggtaactagtggtgtgcacgtactcaggcaagtgtttgactgaacttcaactataaatgacagaattttccgacgaagtctttaaagctgctattctaactgtatttcctgaccttcataaaaataaatgcaaaaggaataaaaagataggatatatcagcatacaaatacacctatcttaaatctattgatatatttatatatcttatatatcctacctttcatagacagatacacgaagaatattaaaaagaagaaaatggacacttgtagaatttcgaaacagtatttaaaataaaaaaaaaattggatgggataaagagcagaatgaagatgagagagaacagagtctgtggcacacagatcaataaacaacatttaatctgaaaaaattaagaaatttacaaaagagagaaaaacaaaacaaaacaaacaaacaaaaaacagacccctagggacctgtaggaaaactgcaaatctctaacagatggtgcttggaatctcagaagaaaaggagagaatggagcaggaaaaatatctgaaaaaaatgatagaaattccaaaatgcaataaaaaacacaaatttacatattcaaggtgctcagtgaactccaaacacaatatattcaaggataatccctcaaaagtaaatgttagcgaaactgttgaaaactaaagataaagagaaactgtggaagtgaacagagacacaacacaacatataagtaggaccaacattagaatgcttacagacttctcattaagaaccatggggaatcaaagtgaaataaagacagtttctgactaaagaaaaataagggacccacactacaaaatatgctcttcagtgagaaagaataatatgataggggaactcggatcttcaggaatgaaagaagaacattggaaatgttaagtatatgagtaaacataaaccactaaatttcctcttaatttctgtataaaacgtattactgttaaaagcaaaaatgacagtatgggggtatgtatgtctgtatgttgtgtgacaactataacgacaaaaatggtgagggagaaagaaaattatacatttgtaacatttctatgttttacatgagattattatcttccttaataataattttcacaaggcactttgaatttttagttactgataaaaatcagattgcctgataattttagaatttaagggtatgtggtaaatgaggtagtttattttcatcaaacaataatagcatcatggattcataaacaatgttcattttttttctaacatttggattacgaatacatttgaaaagttgaaacaagtcactataaaatgccttcaaaatgattgacttaaaatttttcaacttttttctagaacattatgagcttttaaaatttgaggttattttattcttattcccaaaacctaagatgtattcgcttggtagctaatctagttttaatcatgcagttaataaaatatttattaagtaatcctgttttgttggtagcctgtgttttgttggtagcctgtgttactcccaaaggtcataaccttcaataatatagttaataaaatgtggaaaatatttccacaaagaaacaacaggacttgagtttttaaagaataagaagtttgcttttagaatctgtaatgtgttagtcactctggagaattcagttggaaaaaaatgaaagaactgaactgctgagatatttaaaatctagaagcatgaggtgataagtcaagaaatactttgggcaaaactgaaattcgtatagcacaatagcatgcagataaagctaggtgagtacatgttttttctttttctgtggggtgaggggagtgaatagtggattcgctgtcttagaaccacagtttcttaatttcaggtttgaaagttatatacattaatttgcagaaaagaaatagagaccttacaaaagaaaaaagttacttgcaaagactattagggacaatttggtaagtactgttagagaaattaaagatgagaaaaatgagggatacacataaagaatgggattgtcttggttgacctggaatgctacagtggctacgtatttgcagagattataaattgagagtcattctggattcttgtacatcataaaatggagtttaagattactctagctgttgtgttcaggatggatttattcaagaggagggtgattgtctgagatggagtccattgaaatgacctttcaatggagatttgaagtgctaatcctatataggtgtgggaatgaaaaagatgcacagttggtaaataatatgaataagagtgatttttgtggattttgattgaaacaaggcaatgtgaggaggccgagaagataaaggtatcagaaataacttcttaaagatgagtttgttcttactgctagactttgctgacattgagttgacacatatcccaaagtgttatgcaatttgaaagctgtaaaaataattggttcttaaggttacatatagtgatccatatattagttcatttttacttaagaagatatactttaaaatgcatttttaagagttttcctagaatattggacctataaaatggtctggttttttttttttttttttttttggaatcattgtctaatgcatttagcacagcagttctcaacctttttggcaccaggcactggttttgtagaagacaattttttccatggactggggcaggggagggatggttttgggagatttaagagcattacatttattgtgcacttgattactatgattataacattgtaatatgtaatgaaacaattatacaactcaccataatgcagaatcagtaggagccctgagcttgttttcctgcaactagatagtcccatctggggtaatgggagacactgacacaattagatttcataaggagcatgccacctagatagctcacatgcatggttcacaataaggttcacactcctatgagaacctcatgccaccactgatctgacaggaggcggagctcaagcaggaatgtgagcgatgggagtggctgtaagcacagatgaagcccatggttcacctcctgctgtgaagcccagttcttaacaggccacagactggtccatggcctgggggttagggacccctaatttagaaaatacaatatagtatcctagttctcaacattcgcaatgaaattagaaatagctttgaagagtcctgaattaaatatatatatatatatatatataaagaaactgtcttaattttatttaacacaatgtttcatagttgttttaccccacactagggatcagcaacttttttctgtaaagaatcatatagtaaatatatttggctttgtaagacaagagacaaaaccaaagttatgtaggtgcttctacaataagatagaaatcaaaccgctacaaaattttattgtagttattcaaaataaaataataagtacaatgttatgtaatacaagcctacaaatgaaaaaaatgaaatatgtttttgcaggttgcatgtaagtattccctgtcatcaagtccattgcaaatgttggtctacaaaaaccatttttactttgcatgctatacaaaaagaggaacagactagattctgcctatgtatcctagtgtgttgaacaccactctagaccatgaaaacaaatttttttgacatgatgcctattagaatttttttttagaaaatcactcttctacaatgaggagccaaaaagtagtaaatctgattggaatgaacctcatatgagaatgatttttttatgaagaagtagaaacgttttgatgtaaaaaaaattaaaaaaataattaaaagaaataggtagcaatgagcatcttgaggtgtgagttgataagcagcagtcatgagagagggcagctggaaattgagtcataaaggaagacctagacgtcagttatggcaaagaaggagaaggaacactcagaagagattgaattgagagtagaggtaagttggttggttatggagtgacagtttgagaatgtagagttaaaggttttggaatgctgaatggataaaaagccagggattattgaacattattatgggaatgataaattgatggaaggtcaatttttagtggcaacaggcttacaatctggggatgactggtgtgaacaggaatacatgacatgaaagatttatgtgatattgtctgtgtgaggaagggggtcactaagcctagtgtcagggagacttagttgctgtgatgatgggattcattgaagctccttgttctagaataaatgctattacaaagcatcatatttcttgaagcatgtgatgaaggattctggacaggagacttgcactgcaacctgagagactgtgcagataacttagaatctgggtgtacttcctcaattctcattatcctcctttttgtcttcctcctcctttttcccctctttggattacttttacattctcaggaatttcaagtctcttcagagagacttttatgaaagttagttcatgtcaaaccatcatctcttttaatctcttcttatcccatcatccatttataaagccagaatgtttatgcactggtgacacctgccccagaagtccactgctcattttctcctcagtcacattaaatcttttcaagagttatgatgccgagtcatcactgaagactgaatttggactttcctgtaaagtctagctgtctaaacatctgcttttctgcttctattcatttcaggttagtctattctaatgttaaagtatcacacagaaccacacccaccttccaccaaaggctgatgtgaaaaacagtccattttcactgagcacatgttgtttgtttactgtattaatacctgtaggagactcatatgggaaaggtgtttggaggttcagtttgagatatccttttaccttaattgttatattacagtaatgttgagattgttgctatcctgttcacttactgcttttccactagagcagaatgcaaagaaaataatttccagatcaattaaaaataaaacaaaagatcttaggatcatgatttttaaatgtcttgactctttatccatcattgtatctccaaaattggaccagtattgtactagccagtttttaggtggaactattcagaataatcaaagtaaacagtgaataatttttaagaaagtgtctccctcttatctctgtgcgttttccctacatctctcttgttctccaataattcttttacatttgtatcttgaccccactctttctctagcatacatgtctttgccttaacatttgcctttctttcctttgggttctttctatacacagcattttcaacatgtgtcatcttgatctgccttttctcatactagtttctctacttggaatagccctttctctgcttagaaaaatctactggatgggcgccgtggctcaagcctataatcccaacaccttgggaggccaaggcaggtggatcacgaggtcaggagttcaagacgagcctggccaagatggtgaaaccctgtctctactaaaaatatacaaaaattagccaggcatggcgacaggcgcccgtagtcccagctacttgggatgctgaggctggagaaccatttgacctgggaggcagaggtaggagtgaggcaagatcgcgccaccgcactccagcctgggagacagagcaagactctgtctcaaaaaaaaaaaaaaaaaaaaattatgaaaagccaggcgcagtggctcatgcctgtcatcccagcattttgggaggccgagggaggcggatcacctgaggtcaggagttcaagaccagcctgaccaacatggagaaactctgtctctactaaaaacacaaaattagctgggcgtggtggcacatgcctgtaatcccagctacttaggaggctgaggcaggagaatcacttgaacccaggaggtggcggttgcaatgagccgagatcgcgccaatgcactccagcctgggcaacaagagcaaaactccgtctcaaaaaaaaaaaaaaaaaaaaaaaagaaagaaaagaaaaagaaaaatctactggaacttgttggcccagctaaaataccatggctcatctgaagcctttttttgaccctcccatctctcaaccagattcagactgtttcatgacattccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttttcttttttcttctatctttacattttctttattaatacattttaaaactatttctcccaaatagcaaatatatatttacatgtttctttaaatgatatgaaacttacaatatcatttggcattaacatttgacaaaaatgctatttttccaggaagtctacctagctgttctgaccaaggtatcttttctgttttgtgtatcaatgtcttctccaatgaacaagcaaataatacaaatacagacattgatccatatttatgcaatggcaagtgaatgcggttcactaaggcggaagctgccttttagaaggattaagagatctaatctaaaccatatactttgctggtaatttcagctgaagaatttggtttttcttctttgtggaacgtgtagtaacccagtattgttgttgtcactgaattggacaatatcaatgaaaacactagcagacagtttatgttttgttatattggaaaatgcagttagaactgaagggaggaccaacagggaataatttattgcaaacaacccaacatgaattactgagaattaggcattactctgttgaatactttttgacatgcttttcagccccaaattaaaagttattagggcatattgtgatgtagttatgtatacatcataggtagtatgtagttgtatcccattgtaacagacagattaactgaagtacgagggatagccaattctatagaatctcatagggagaaaaagactcagggaagtattctaactgccttttattgcggatcctaagttatgcttgaatttaagtgattctcatcctcagtcatcatgggttcaattacatttaagttcataagaatactaacaggagtaaattaattctggacatgggcattttggaaccaagttcgcttttctatgattattttactggtgtacattgtgtttgaagaatatagtaaaaaaaaagttggatgtttctgtattgcaaaaacaaacaaacaaacaaacactatttattcatttgtggccaaaggtgccttgaaattttatgaagtagtataaaaagtcaagctgtgggaaaaatgtgcatgggagataaccaagcctagtcccaccttctgcatttttcagtttgttttcttatcagcctgcccataaactggaaaagcattaggcacaaacccactgataagcatatgagaatttcttctagtgtccctcattcttctttatggaatctgttataagaattttggaatccccatttgaaatacaaagagttacaatacaaatgtaaaaacaaattattgtaacgtcagaggctgaaatgcatatgcaggatcccttttgttaatctttggatgaatgagagggagggacacctacctgggaagaaagagtagtaaattcagctcactaccaacagaaatgacagtgaaggactttcttaacattgaggctttgaaggttaaactgttgcatgtcactttccaattaggatgcctgggagtaagcaacagaaatagactcaggcttacttcaagagaaaatgaattcattaaaaatattactgggtgcagcacaccaacatggcacatgtatacatgtgtaacctgcacgttgtgcacatgtaccctaaaacttaaagtataataaaaaataaataaaaaataaataaataaataagaggacaggctttggagccaggctgcctgtatttgtgttaagtttcaccattacctaccagctgtgtaaacttgggcaagttacttaatgtctttgtcctcagtttcctcatctgtaaaggataattttaaccacttcttaggtttttgtgagtgcttagaagcaaccaacaaatgttagttctcaaaaaaaaaatatatatgtatgtatataagttctcagaatcaaagagaaagttggaatttcaggactggaaaatgaacaggagttaggagggcctacacgtttttgaacataggaatgtgttcaggaaaatctgatgaggttgctgcaactggaagccacgtgaatgggcatgcaccacatcacccttgctggatgctgagggtctgctgttgctcttgcgaataatttttcaattacagttttattatctcaaaattcagggtcctgggtgggggcatgacctaaggatattttatctggattttgtcttatggttaaagactgggttgtactttccactgatactcacataatacaaggatcctccaaaatagaaagggaagtcagatgtggagtagccaaataagaggaaaaaaatgtatactaggtagccggtatagagaaaatgggtgcgtggtcattaatttaccatctttaaatgcatatacttattttcagcgtaactggataaaaatgtctgattctttctaaattgtaattatatcttttatcttttctagcaaattacttactactagcttccagtaattaaaaaaaaaaaaatcaaacatctatgtacaggtacactgaccaatatccatgaactgattttggttgatttaaacctgtagacaaccatgagaagtattaatatcacatctttacaaatgagaaaacagactcagagagatgaagtaacacgattgcccaaatattacaaagagcaattgacactgtcaggatgagatctcatgtctctgtgatagaaatttcatttttctacagaaccatgaaaaaagttatctttcagataacgtagctgtcatttcattcactattgactatctctacatttcttagatctctttttttctgtatttttttctttactaaaaatcgtgcttttatttttattttctattttgagttctattgcaatcagtcatattaggcagtaacattttctcctaaattaatgccctcatccattggttttatttttccttattctccatatctgtattaatttgtgtatggttttaatgaaaagtcacattataaaataagatcttgtatttttttaatctttataacctcaaggctcagcacagggcctagcacataggaggtgcctgatacatatttgctttatgataatgggctcgaagaaggaaaataaggcatgacaatggggtggcaaaggaaaagtgaaaaaggagaaagttgggtagagaagaaaatggatatgcaatgactagataaaaccatcttctagcacttcgacccgcataaatcaacacataagggatttttaaataacagttataatattgataactgtttgtctcctgtgggttccagtttatttctcggggcctgtaaatatttttcttaatgttttcaattaccaaaatgatttattcatcacgaggtcttctcttatgctaaataagttttatgaactgacatagccaagagaaagtctgttattatattccttatattccatttattggagttggtctttttgctaacttttatctggtatccatttatctcctaaaaagcgtggattaaaagataaggctttaggactggtaagtgacttacataattatgaatttaagacaaagggacatatttcatttctttgaaaatgcataaagtgctgcaaaggttttaagaaataagaactctttgaaagggcttcctgatatgaataattgcaaatgtcaagggatgagagtttcctgatagtgattctatttctagaatgtcaggtactgatgcaaaggtgacatgagtgatttgaatgagttgttctatgtctcagagatggtcccatagagaaatgaaagcagtgctttataaccaacagagagatttatttaagaccaaaatgtcagaggtaatcaaactgtttaatttgtgctcatagttttgctttgcattatataactggacacacagaatttattgtatactgacaaattatggaaacagaattttataaaaagtaaagttgaatgctgcattgtggctttcagtaaattttgataaaagtctttatggtaatattcttaatgaagtataaatgctgatatatattctatataacatttttccttttgctttaagtttatattagcatgcatgcaacaaaatatacagaactgatcctcgtgaacacttccatgtgcatggtgccaagtgcagaaacaaaacatcgttcacactattgaaaaacctgtattctgacacctaccagtaactatttacccacaaagataatcattatcctgatttgtaacatcgttattggctatcacaaatagcattaccaagaacatttttgtatgcgtcttttgatacagaaatctatctatctacccatataagtttctgttaggtatataccttagagtggagttgctgagtcagacctatgctcagctttggtaagaactgtcaaaaggattgacaaattgattgtaccaatttattctcccaccagcagtgcacgagggttccaattgcttcacatccttggcaacacttattagtggctctctttttcattttagccattctaattataataccaaaatattttgtgtgtgtgtttgcttatatatactcctactaccaaaagaatgtaagtgacataaatcaaaataagcacttttcatttatcaatttatacatcaagattttaaagagtaattcctccagatggtttctagactaaaatgcagcatattgcttagaggaggaaacttttcttcaatattcgatgatccatctaaaaatatgtcttaaatatttcaaaaatttatatttattaaacaaatataaaggttttgcaacagcttatgtagatgatggaattcaaggtgtcttattcttacaatatctctgataaaaaataactgtaaatgtacttatatgttttaatatggtctatatgataatacttttttatttattgaaataaaatatagcatgttggaggtttctatgtgaaatagaaacctaatagtgattctgtttcactgaagaatttccatgtgtctcatttatttccaaaacaatattacatcaaattaaaagacaaatatttagtttattctaagatgtgttcttaaagacattgataaactggcatgactaaaaaattaaatgaaatcaaatttttacctcataaaacaaaaggtctaaggttccagataaattttgaagccagtgttttgtcaggggccatggtaaggctggaatttgggtggtgggccgggagccaaaaagagctgaggatatggttgctggaatgttcaagttctattaggcagggaagaaggtgagaacttcataggctttgaaagatatgcaaccagtgctaaaaagagccgcagtgattgactctggaaggtgaagcttaggattcaagtgggagatactaaaacattggcattggaattcacaaacattttaggcatgtacatttaagacatatgttaggaatcatgactccattttgccaattataattcctgttaggcagaatatctgaatcattcttctgccagcagtcccccatgtccatcacctattctgtaactatcaccaattattttccccaatattttcctaaagctgattaaacactcttgggtcataagaaatttacatttgtcaataactgaaaaaagttggttcaaactatgtgatctagccttcaagctgccctatggttttgtacaaatttaacctttagagcaaccatatcatcatatgtatattatcacaaaaattaatgttggtactttattcataaacatgtataatttacatacataaacttgtataagtcatgtacaacaataaatatagtgactaatcatcagggaaatgcaaatcaaaactacaatgagataccacttcacacctgtcaagacagctattataaaaaaaaaagtgttggtaaaaatgtggagaaattggaactctcatacactgttcagtatacaaaataatccaggtactatacgaagacagcatgaaagttcctcagtaaattaaaaataaaactaccttatgatctagccgtgccagttctgggtatttattcaaaataattgaaattggaatctcaaagagttattagcactcctatgttcattgcagccctattcacaatagccaggatgtagaaacagtctcaatgtccatcaacagataaatggttaatgtgccatatacatgcaatggaatactatgcaggttttaaaaagaaggaaattgtgcaatatgcaacaacacaaatgaaccttgaagacattaggctaagtgaaataagccaggcacagaaagacaaatactgcatgattccccttttatggggaatcaaaaatagtcaaatacatagattttaagagtgaaatggtgattgcaaggggctgagggagaagggaaaatgggaagttactaatcaaccgacacagaatttcagttgagtgagattagtaagctctagagatcagctggacaacattatacctacagtcaatgataattcattgtacgcttacagatttaagagggtagatttcctgttgtgttcttatcacacaatttttttaactctttgcaatattttcctagccttttctgcttgactacctgctttccacttctgtaccccactgtacctcctcccatattaaaaggcaaacacagatccttccatagtctcttcatgcttttgtgtatttgtaaaatagagtcatgtatcacttgatggggatatgttctgagaaacgtgtcgttacgcaattttgtcgttgtgcaaacatcatagggtatatctatacacacctattttgtatagcctactaggaataggctatatggtacagtttattggtcctaagctacaaacctctaaagcatgttactatattgaatattgtgggcaactgcaacacaacggtatgtatctttgtatcaaacatatagacacgtagaaaagacacagaaaaaatagaatattaaaatctcatggaccacccttatgtatgtggtctgttaccgaccaaaacattgtaatgcagtgcatggctatattgtacaagcaactatagtcatccatttttgtactgtttcagtaaaggtttccaaatgggaaaacagatattactctagtggtccagatagaagagatttaatacagataattgttacaaacagtgtcgtaaaggctggaggggccaaagtggtggtatgcagaacctgtaaacacatgttgccgttatcaaggcaggaccccgggcttacactcccgtcaccactgccactgaggtcctattgctgaggctggtgtgccagagccactgccagaggcttccggtttctgactggtagagctctcctttttttgcagaaagtaactagaagtcaactagcaaagaagctgagaagactattttgaaaggaagtcttagaaatgtaaatttcaggctttctaaccacccccagtaataaaaaaccatataggggcagcagcgggactgacgaccaacagacaacctccaatgtttatgtgtcggcgagattactgatagtataaatttatgttagtattgtcattgtctggtatacaaagatgggcttccgtcgaattctttgttgtttttgcttttctttggttttctctcttgcttttgtcacttgacgatatctcagtgaaatttttccaagtcaactttattcttttccaagcacaaatttattctcttcaagtcatgaatgttattatatggtgtggatgaatagtaatccatccaggcattcgattatgatgagttttcatcttgactctgacaattacgaagagttttcactttgactcttctttttagttgaaataaacatcactgctcattgctctctgcaggttggtgtattttgttgttgttgttgttgttttttgtttttttttttttttacacggctaggtcccaggtttaggattgctggtgagatggaatatgttttgtttgcaattgccattttatattcccaaatgggaataacacattataatttcacaactaaattagaaaaggacagttttcactgcatccctgccaccaataggcattatctgggatactttcttaattacaattttatttcccagaaagcaagccatggtggaatgaatgcaaatactatcccaactccagtgtaactttacagatctttccaaaccattataatgcatggagatttttgaatcattcaccattttcaaatttaaaattgtcatgaaaattactcaaatcagtgaaggcagaatagcgtttcagtaatatttcagctaaaacaagtctaatgtttaattatgtatcttttattttgtgtttttattttcttttaagatggctaaaattttgtgagagtgctgctattgtaggtttgtatctgccattgtcgcaggttgaatcacttatggtaagctaatttatattgtaactgcattccaactcaagatcttcatagactttaatatcaaattttcatttcttgccacatgttcatcacaagttgtatgtcagtgtggagagaatctgcctaatggctcttcacccagaaatccaggctgctaggtgtccagcatctggtgaatttgctggtagttgtggcagaagagaaggtggcaaattaaaaattgactcttaaagacttctgcccagcagtgatgtatattgggtccaatcatttgttaatgagcaacattgactaacacattgattcgaatatcccttgaaacatttatgacatatttcctaacttgacataatgcagcacatagtatttcaattgttcttctatttttttttgtggtgactttacccattttgaattattttatgggtagagtaagaccattgattttgaaaaactggaagttgactggctctgcaaattgaagagttagctggtaaaatagctttccctttttatttgttgtgctgcttaggtgttgtgtttgttcttgcattgctatagagaaacacctgagactgggtaatttataaagaaaagaggtttaagtgattcaaggttctgcaggttgtgcaagcatggcatacacatctgctcggcttctgggaaggcctcactggtgtttactcatggcagaaggtaaagcaggagcaggcatatcacatggctagagaagcagtaagacagagtggggtggtgggatgccacacactttcgaacagccagatctcacacgaacccactcatattgtgaggacggcacccagctgtgagggatgcatgcccatgacctaaacacctcccaccaggcctcatctccaacactagggattacatctcaaaatgagatttggcagggacatagatctaaaccatatcaggcgactcactgaagaaaataatagtataaaatattatggcagtttaatcaataacattaggataaatagcattagtgtgtgtcatattttcattgtgattaaatctaaatgcagcccttgatcattgtcattggggtccagtttaatttcctcagagtgctcagacagtacctggggatacttgcagctctcaaattgttactaatggttagagttttcaattatttttgaaacaaatacaactcaaggataaactttgataattgaaaagggattaggatgttaaaaatgcacactttcatgaagacagctacttattttttatccactgaagaaaacatcttatggacattctctcatattacagctttcagtggcatggcattagaattctgattccatattgcttgttcttctacattgaagcagatgtcagtttcatatggattctgagtatccagtctgtcaaatataaatgtaattactggtcaatagttttggataatttttacatctgttgaagttgtggaggttttattaattattttgacttagattttattcccttcagaaagctgagaattcagaaccatattactttgggtgaggtcacctccactcctaataagagcaatatgtgctgagtagtcccggtgtgcatgatctgtgctgttatgactcacaagtcccactagaagtttcaggtacaggaaaggaatttcctccaaataaggaaaacgttgtgcacctgtgttgtatactgtttgtgaaaagcaagaggatgtagtattggaaaggtgtaaagcttatgctttagttggctagaacaaagttcatattttttctcagttatcaggggtcgtgaaagtcattaaatccaacttctatccagtgttagggaatctgagaggtaattctcaaacttttgcctaagtgtgatccacataattttagtaataagcttatttcctatttcattgtctcacctgagaactttctaactgaggtggaagcaataaatattatttgttaatagctctctcctcctccatgtcccttgccttcctactattaatactaccactattgctgctactgttctgctcctactcctaatacatatttaactaatataacatgtactctaccagacaaaacgttgggataatttacatatcagctaaagctgtagaggcttcattttgacttagagtttgttgcctccaacactcttaacattgtgaaccaggttatcttgtgtacagtccaccctgcttttagtaataccccaatgtgctatttattctgcattcatcatctcatttactcttcaccacagatctgtaaggtatgtgtgagccttattcacattttataaagtagaggaccgagatttagaaaggttaagaatgttatcaaggtcattaggattttaaatttaggctgcctggctataaagtccacgcttgtaaccaccctgcagtaccctcctttcattgtttttatttatttttaaattcttactctgatattgagattctcacctgtggtataaaaaagatcctgttgtagcggtggaattaataattaaatacacccacctgtaaatgcttgttaaatcaccagaattaaaatagaatatccatgaaatgttctagatgttcaaattgctcttgtcactgtgcacaccaagatttaaaacctagggcctcgtaagtattcagacaattgtcttggaagatcttgtgttttctctatttgctactgtgtgttaattctataccatgctaggatacaggggccctatgccatctttcaccttcttagtagaatgtttgatctaaatagcaatttggcttgccctggacaatgttgtgcttcccctaaccaaagaaacatggttctctggaagattatagtaccacattggtcagcagtttcaagtatttggcattgaagacattgtaaagcgaattataaataattttatcctgaattatctatatcataggcacattgtgacattgtttagtttgcaccattgttcctgttgttggggctattgttgatattattttggcagactgtgctatgttcaaattaagactctctctggaactctcagttataaggttattattattgccgtactatttacaaaagagttgccaagactggtgcactggaagctgtgttccacttatcaattcaaaggaattttagtatcgtttctaccatcagggaatctgtgagctgagctagatagaatcagagagattatctagagattattttattgatcaccaaatgcatttttgtaaaagtaaagaccccaaattgaagctcttcaaacagtcagttggtgttactaaaatggcttatagttacagttatcagtctcttgagtaagcaaaatgttatctcaaagccaaaacaattttgtggtatggagagagattattaagtagttgaaatattgttgctgaaaatatggatttaaaagcatcaataccaagtgccatggaatttccaaatgacaacttgatattgatacaataaaacagaaaaagccattaataattgaaagcaataaaaacatatgccttgaataaaaacaacttgaagcccgtaaataatacaacatggctattcagtgatcattctgtaatattaaagtttcaaaaggcatcctaacgtgttggattttttgtttgtttcacatttcctgatccagatttatatttttgaaaataatatctactatcaacctgatataaagagcagttcattgcgactgacatcttctggaaaagaagaaataatttttaatgggattgctgactggttatatgaaggtgagttgatcagatttagtttcaaaggaaacaaatgacatatttttatacaaaatctaccaaaaaaaatctattcattccggagcaatacttacagtacagtttcttctcattttctctcaaaattgccctcatgctttcatatctttgcatgtgcttatattttgtgtggttgagatttacatctacttacatgattccatgtttggtgtatatatgtacatataggctagatagatattatttgtgaggacaactaatgaaagtaaatggttaccttatgtcactttggaattagatgctgaattttttctgactctctgggaaagaagaaacagaaacctttatttctaaaaaaaaaaaaaaaaaatgcataaaaagccacctgattttagttatttccattagggacattctgtcacactttataagctattgcagagggagcaaaataaaacccacataaagagttattttcaatatctattgaatcaagttttagtaatagctgagaatataaaaataaatcaggtgatgaaaatttatccagtttttatcacgtaccaattatcagctgagttctacatatagattgcctgggcaagactcaaagtatgagtttattacctatgtttcagattcttcagctgattttggcaaaatatgtcaagatttaaagtaagtctactttattataaattataaagctatgaatcattcaaaaagtgaattttatttcatgggcaatatttgcaaatgtaatctctctacctcagatttgacatttttaattctataagaaaagtgaataacttagaccaattattcattcattcactctttcactcaaatgatatcattgaaggcctactgtattctggatagatgtctaggtgccaggataaaagacggagcaaaaagtactgctctaataaaccgtatatttacgtgaaatattttgttaggtggagctattttattaaagaagagatgttgtaacccttgagatttatatgtatatgtgtacatgtatatttatatctataatagatttctgtgtacatgccagcatgaaataagatttttagaggctacaatttattgtgaagagcagtgagagcttccccgaaaatattaacaataagtatgctgtgaaagtatatattagaaaaagaaatacacaggtaaggagtgttcattggttgagagttacagaatctaaatctggcttttctatttcaaagagatacattactggaggggactgggatggccctcagaatttaataaacaggtggacaacacatttaaaatctggttagttctggcagtctaggtagcaggagctaattgaagtgcagagactaagacgtgccctttttcttcaaaatattattggtactgtgtgacaccctgacagatgaagaaaccatgttaatgcagtgtggtaagtagttgaatcttaatcaacacagaattctatggaagaacaaaggaatgataccattctagggatttgcaagcattttttctaaaggagaaaccctggccaacaacagtagctcaagcctgtaatctcagagctgtgggaggccaaggtgggagaattatccaaagccaggagttccataccagcctagacaaaatagcaaggttttcatttctactaaaaaatttttaaaaattagccagatgtgatggcatgcacctgtgttcccagctgaagtgagaggattgttaatgagagaggattgcttgagctcgggagttgaagactgcaatgagctatgatccaggcccctgaactccagcttaggcaacagagtgagatccttacctcttaaaacaagggagagagagaaaaagagagagagagagaagagagagagagcatctgagtcaagcctgaacagttaacaagtgttacgcatgagaagaaattaggaaggaaaaatctaagcagatgtaacaatttgcaaaaacccacaagtgtgtccctagggaaccaaagtctccttgatataattgggccataaaatttgagacaaaggaaggtagcaagaagcgagggatagtgacctctatcaatgatttggaatttcaattattttcctaccatttaataggaaaactaatagaagttttcaagtaagggagtgacaagattggatcttccatatgaacagattgtttttgtgacagcaggaacctggggtctaagagtggaaagaaacggtgagcggctgtaaggcttcttctatgttctatcaagagataatgagcaatggaactagggttaaagcagtaaaaaggaggaaagactctaaaattgatgagacaatgaaatatataggtcttagtggctaagcagatggggtgaatgataagaagtcaaggatgattctgtgtcttctggtttgggtcactagtaagtagtggtggcagacatagtgagcaagcattaacaaggagcagtgggtttcagggaagagaagactagattagcagcaatgcgggcattgaaccacgtactgacgtgctcccttggtgataaaaggtggtctgtaacgtcgatgaagttttcagtcaactgagggtatactcaatgtagaccatgcttattgtgctgctccgtcccgaattaagatgacttgggtctctgtcctattgaaaaggcttcatacatttataaggaaattttaaggagagaaattagagaccgtttcctgacaaatacggtaattttcttaactaaagaataaaaatctatgtattcggtctgagagtaaactgtttgtaggggttgtggagagcagaacaaacgggtaatacaaacttttgtgatgatgctgtaggtctgacgcattccaaaggggaaaggaaaaagtatagtttttgccatactttgggctcctatgttgccgttaactaggaaatgctgtacgtgtatgtgatttaatcatcaaaatgtttgtgcatctaatcatttatgaagaaactaagacgcacccagtgctgtggctcatgccagcaatcctagcactttgagggggcgaggtgggcagatcacttgagcccaggatttcaagaccagcctgggcaatatggcaaaatcctgtctctactaaaaatacaaaaaaaggctgggtgtggtggctcatacctgtaatcccagcattttgggaggccaaggccggtggatcatgaggtcaggagattgagaccatcctggccaacatggtgaaaccccgtctctactaaaaatacaaaaattagctgggcatgctggtgcgtacctgtaatcccagctactcgggaggctgaggcaggaaaatcgcttgaaccagggagttggaggttgcagagccaagatcatgccactgcactccagcctggtgacagagcaagactctgtctcaaaaaaaaaaaaaatttaactgggtggggtggtggggtagcacatacctgtgttcccccctactctggaagctgaggtgggaggatcacctaagccaggaagttgaggctgcagtgagccaagatcatgccactgcactccagcctgggcaacagaagcgagaccctgtctcaaaagaaaaaatttaaaaaagaaaccaagactcagagaggatcagtgatttagacatggcctcagagctaatgagtgggagagccaacatttgaatgtgtgtcttttgttcctaaagccagggcttagtcactagtctactctacttgttatagggggatgtccttcactgttccccaagacacaacacacgttttgggacctaaattgtcagacttcagtgatctgtttcctcagccaaagactcatcctactgtccatggacttactctaatcctcactgcatttccaggaggaaccctacccatgacttcaatgttaaggtttggcagagggatgtaagctattcagatgtttttgattttccctcactattttgactgctacccccaacctctgcttcaagagtcctacatgcaccttaccctcccactatcaccttgcttgtggaatgtgccaggagctcccaagctccagaccttttttttcccctttaatgcactcactgaaacacaatgatattgcctagggaatgcatgtaatttcaacgttatgtgtgtgatactctggtgtggagatttcctttttattactttacaggagtcaattacaatctaaattagcatgtatgggagacacagaaagtaacatgtaacatttcaacttttttaaaattgaaatttaccttttgtaaatgtcatagaaaaaaaagatgagagaaagagtgacataaaagacaataaaatatttttacagtaagctttacaggcatgtcttaatcttttaagaccaggccaatctgtaagagtggctgctgcccccaactagtcactaaatagagtccttaaaagtgtcagttttaagaatctttgtctctatttttagtattgtttagttcctaaagaaagtaaagcaatataaagtataatgcattttaaacagcgaagtcagaaaaataagaaaatgctcaaaaaggaagattatttaaaatgtaattcgcacaaaacacgtataatgttattcacttaaattgctgtatttaacctagcaatgtaattaaatacgatatcagatcaaagttttactttaaaaacttttaaaatgttactaaaaagaaagtttacagctacccacttcacagctttgaaaatttccataaagcatttaatctattaaataggaaaaaaaatgactcactttcaaatatttaagcatatagaataatggaactaatatgcttaagtgatttacagatatattttagaaccttgtatatttaagggattattccttaaagtttaatccaacagctgtggagcaaatatacctgccaggcattatctaagagcaatacgatgagaaatacgggtttccatgtcttgggtatttccaacttagtgtagtgataaacaataaacaactattgtattgggaaccatttggagcatagtaaatataaatataaataggatttatttcacatactaaatagaattataagtagaactaagtttgataggatggaggaatgtcaggtgcttcatagatgacatgggccttgtgttggtattcaagaatgacaagaatgaaaaggtgcggaaaaattcacgagataagcaatattcttatcagcagattctgattgttacactttttttgttgaaataaaacagggcaaaatgcctattttcaccttcatgtttgtttcacattaatgtttcacattaatgtcttttggcgacatgaaattgcattcatttcatcattgattcaacaaatatttattgagcacttgctcagtgtcatctatggggctgcagcatgggagtcacaggaaggcagggttatcagtagtgctgagtctccagaggtcaaacaagggaaggattccaaagcttttgttggatttgctcatagatcatcgatggccttgacaggagtaaaatcagttaattggtggggccaaatccaagactgcagtggatggacatgtaaatggggagtgagaaagttatgaatagagactattctttcaaggaatttgacagtgaaatgcagaaaattgaaaaaaaaaaaaaaatcaaccacaggcctgcagagctgcaagtagcatcctcaggaaatcctactggtctgaactgacaaactaaaaatggaaaaaatcagcttgctttttacaataacacattaatctaaacacaatcgttgtatctcagtattgtggaagtgctttgtgttgtggctatgtttttaagtgcctgtgatataaaaccacatgtgctgaaaactccatctgctctgcagtgagattttctaaatcagagtaataaaaacgatgaagagccaaacgtacactaaattggaatgaaatgccatttgtaaaaataaattctttgtaaataatataatataattaacattggaagtttcaatccatgagtaaatgtgcccattagttgcagttaaagaagcttgtgccttatccaggatgactgttaagcaaatgcatattaaagattattttatttaccaccttcccattccaggtagctttatctttccatctgaagaaagtcacaaggctctctatatgattattttggtacattagcatttttatggggaagaacattaatcatatgtcactctaaaataaatgagagtaggcgatgcctcatttctcttgaaaagcgtactcaaatttgggtcaggtttattcttgggaagtactggacacacatatttcagcacctacgacagaacctgtttcttagaaatctagagtattgattttagccaacggggtatctttgtatcttcaaatctcatagaacttagagtttacggtggggccgggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaaaaaaaaaaaaaaaaaagaacttagagtttacactcaattggcccttagcatgcatatatatacacacacacgtatatgtatatttttttctgaatgtgtcatgtgtataactcatgtctccttaaccaaattgtaagttagttgcataaatcagtgtcaatatcacaactgaagaaaggtggcacgttcaaaagggagtaattcaaggagtttaagctatgaaggggccccttatcatgaacaaggtaaatgccacaaccgtggcttgtaatgatttagccattaacagccaaagggggaaggggacacagcagtcacctgaaactaggagagaatgctatacaatttttacagaaatagaagcagtggcttttggttgggcgaagccaaactcacataatttggatgcatgggagataagaaaataaattccacgcacccacttcctcccttcatttgattcgccagggtttcatagtggtcatacccaagaaaaagtcaaagaacataagaatattcttattattcaaattaaaagctagtgtcccaggaaaagaagtacataaaatctcatctgctattgtttcattgcaggatggtattagtcctgttatatatctgaaatctgtaaacatagccaccacttgtatttttcatagaaggttgtggagaaatgcccccattaataataataataaaaacttattatgtgatcttagttagtaattacagttgccttcttccaatgttcatttcttttacttttactttctgtcaggatgctacagaggttatttaacaggtggatcaggccaaaatttcattcctgccaaatgttactcctttccatccttttctatttttttttttctttgacagagtcttgctctgttgcccaagctggagtgcagtggcacgatcccggctcactgcaaactccagctcccaggttcaagagattctcctgccccagccacctgagtaactggcattacaggtgcccaccacgcccagctaattttttttttttttttttttttttttttagtagagatgcggtttcgctatgttggccaggctggtctctaacccctgacttcaggtgatccgcccacctcggcctcccaaagtgttgtgattacaggtgtgagccactgcacttggccccatccttttgttaattatgttgttacaatttcagttttccatcgaccagtactattgggcaaaaatgtatttgtgactctcctgagttccaaatgtatttctccttgccctcctttgcacagcaaacatatttttatttctggcagatgaggaccatcatcagacccagcttagtaactgtgttttgtctttttttgggggagttgcataatgagcccacaatggtggggagaaaatttccgtttccaattcagaggaatagaattatgactatattcctggtggataccctcgtcctttaggcaatggacttctaaactcaccaacttcaatattatgggaataagaagcaaattgtgttctgtgggttattgctgtgataataaaagataacactactacttctaccccttagtgcctagatctgtacctcatggctatacaggtggggcacactgcatgttaaaggatgacatcccggcttcaaggttattgctaaacaaatagtgccaaaactgaggtagagcagactattttactcctctatcaatccaagtacatatagctagtggggaacatgataaaattagtaaataccaccactgagcccatggtgcttttttgccacaaaatatttccttttttgagataaggtaatgtggattattatggtaatggataaatgtttctgtaaagagtagtgctgaacagatccattggcagcaaaagcaaatccatgcccagaatatgtgtgtatctctgtgatgacaaaatgctacactgtcttgatggaaaggttttcatataattcatgtgccttcctcattacattatctcaaaaaaggaaatattttgtggcaaaaaattcacgtgccatcagctcttcccctgagaagtgatcctatgtcaaaggctcagcgatggccactaccattggcaggtaatggtgggagccagaggctgacggacatgtacttggcagtcatcttgtcctaaatttttcccctttctagtaagtcgattcacttgtttttcctaaacctccctgtcactagttttctaattttacttttgccacatccctgataggtggacccttattagttactgcacttgagtcaggatgtttccatgcctgaaactaagtctcctaccacgaacagtggacaacgaagtattctgttcaaaatcttaccaactgggaagatttctgtttcttattgtctttcagtgccactcctgagtcagattctagtatggagcctacccaattccagctcgttgttgtacatcctgcagacctgccataaaccaggcccgcgtttatttctcccttgccaacttgtgttagaaaacatgctttgtggcacagatgtgagatgaggagaggggatgaagcagagaaggcaatacaatgggcaatcacatttgttttctggctcaatttcacttttattttatagtggaatggtgtgtgtgtgttcagttctatggtcagtggatcagatagccatcagttcatgatgggcagtttgggttgcatactcacttggtatcccatggtgaggctaaatgtttctcctggagccctggaaagagctgcccttgaaatagataatatttttcagtacaagcgacaatgatcttttttcaaatcttgtaatgcctgtcctatgattgtcatatggagagtcccaaaggctccacacagcatctctatttgccatgggcactgacattgccattggatctgctggagtcacaaggttcaggacatagaggaggttgcaacatggcctagatcagttgcaaggccccctggtacactgattctactcagaactagcagttttacagcttgcctgggatatagaacagagaacatatgtcaatgcggcttgtgttgttttcaaagtccaaagaattcaattcctctttacttttacataagtacaattgtaacaaattttctctgactttagaagagatatcccggtgtatcccaaactactagatttctagaaacatccccggtgttgcacacttttaaattttaaagaaatttgtctccctttctctacctctatgcagaggagttctagttccctaggatagcggttgcctctgtcagcaagaagatttgtcagaattttgatgttcaatatcttcagccataaaattaaccacatacagcagcattcaaccataatgtgttatttataagattggccaagaaatcataactatactgtatgcttttgtccaaacattcttatcctgtgtgttggggtcccaatccatcgttatgaatatctttgtcttaccctaaaagagcaaatggagttgagcctctaatatgtattgcagccgtgtacccgttcctatgttctcttggactgtggccatagtttccctgcaactacagaagagatggactcttccaaagataccatcgtgacctttggttttgcatgggcattcctgatttcacaatcatggtttcaagctttcttttttcctgtgtactatctgtggggtgtcagaagaaccatgcgaacttgtttcctaatctttacatcatcattgttgtagcaagtaagtgctacaacacttacttgctataactagagatgctgtgtggagcctttgccactctccatatgacaatcataggacaggcattacaagatttgaaaaaagaccattgtcacttgtattgaaaaatattacctatttcaacaagcatttgttctcccaatgccttttccctctacctgtattttattccatgtcaccaccactgatgattgattactcacagttccgtctcttgctatggattgtctatgctccaattcccacttgagaaggtgataaattccatttgtatatatagatagagagatgacaaatgtagtctcaacatctaattttgagggtctcttctgagtctgctgctattattaacttctgtatctgtcagagtcccaagtgttggcacattcaacaagatgctttgaagataattgatttacaaagtgaacattttattgtctttttatttacaaggagaacatttgctgaggttaaggggtaggaaaaccacaaaggaaagtgatgtaaactaagctagtagcagccaagttgttagcactcctatgaccatgaagatgagccattactagacacataaggagaaatttgtgtagaggtggctgcagtgacagaagtagtgacatcatttaaagttcacagccagcctgaggtaacattgtaggatagagccaagagaataaataacctgactttactctcctctttctaatctcctgccaaagggaagccagaggacatgggggccattttgatgtcgttcatataggttagctttctggaccagaaagcgggaatcaaaaaagtggatagtggatcttgaattaaatgaaagatacccagtatacttcttattccattttcttagagcttaaaatagtttgatgaatctagtgggccctcagtttggttgatgatggtagaatgcaaatatgattacatgcaaatgtgaatgaatcatgacatggatatggttttaggccacatctcactcttcaatcaccgttctcattctgattactccagtagtgctttcatctgttctgtctacattgctgaaaatccatgaaatcctgacttaggtgcttcattgtttccttcctctacagctgcttgctcttcctggaattaaaagggtgactcagaattagagaattttcagggaagttaataaaattcaatacacagtctagaaaatataggtgtacaatggagatttcaaggacagatgtttgtgggtcactgagcccacatctctacagttggtctcaaataacactcatttattctagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggtaagtaacatggaagtactattttgttccttctctctctctgcactagtgacttgacagatggtattcttggttcttgaacaagttgtctttggaggaaaacagaagttttccttacttgtcagactcatcactttcgatctcccagtagtctatacacagtgcttgggtagagagaggtagagatgatttgaaagtgtgtgaactttcacttttgttgcatttctttccttttgatgctcacttttattttttcacaccttacagttgaaaggggagagagaagcaattgggggtgtactgaggccagggcaatgttttgtccaaggcctattccataataggtgttacaaaggaggggaaagtgccatggtcaaatacattggaagttcttaaaaaaaaatctagcttctttcagatgatttcttagagcacttaatgtgctatatgttaatgtatattataaatcttctataaaaaatagactatgcataaagaatctccagtctgaaatagattaagcataaagaatctcaataaagaaaggaccaagtataaaaaaatcacccataaagaatagactaagcagaaagcatttattagtattagtatcaatatcagcattaccttggcagagcatactctagaacacactatataaaatgctggtatggagtcatagccatggttaggtaagacagatggaatttttcatcaggtgaagaaatatggcaatatgttccagacagcaaaactattttcaagtgttgggcaaggcctctataagagggttgcaaaaacatctggattgtactgttttttcctctgtatgccatctttaattgctcgagatctcttttaaacatgtattttttcccaatgtttatataacaaagaagaaggctcatgtgtaaggcccccagtatattaatcatgtaaagaagtcttatgggaaacgtgtaaaatttctcttctcattttagctcctaattaagtaagagaggatgttgatctcatttagaagccatttttaagccatttctttagtgagttgtactttgtctttttcaagcacaataggttttctgccgtttaattcatgcactacattagttagacaaactactgggtaggttcccatcaccctcattactctagccctgtcagggtgggggtgaggtcatttacactttccttctgttcccaccagccaccatattcattttatccaaaggcaaaaaaaggaggcttgaatattgaggatcagaaataaaatgagcatattcctcagtgagatttctcatccatgttccttccacaggttgtagtattaaatgcaagattataaagagtatgattccatgattttaaaatgtgatttatagggtcttctctggacatagattagaaagcagatatactcagtgctttttaggagaacataatgatttaacttcacaaaaaaaaaatactaagagatttttattgtactcaaagaaaagaacttctgctttctccaattatagatttagctttttttttttttggcatgacagtttggacctatacagcataccagcactattttttcccccagagaaaacctgaaaagttgccccaaatatattaattctcacattgtttgatttatgataataaatgttcacctgacaatttaaatgtgaaatggagaactagtgacatactgtgaaaggcacattcaactgttcagtgcactgcacaaagggaatacaatcacatctgactgctcaacgcactgcacaaagaaaattcagtcagttctgtggaagggacaactgtttgtaactgatttcccaaaagaaatgggatttttttttattcacatagtaaaaccaaatgcattgctgcatgctcaaattgccttcttagttctagactcatggtgcttgaacttggccatgcctaggcctcataattttgactagattgagacaaacaaacaaaccaatgggagcatttgaggaaattaaattatgtcagcaataattcagaagatactggatatgaacctagatactttatcatttgataatgtcttctaataaattaatattgcttaatagtaaagataggcgtaacataataatctttgtttattaattgtagaaatcacaggtactaatgataaactttatgttttcagggagactttccacttgtttgtttttttcttatttggtctttatcacaattgtctcaattttacaaatgagcaaatagattctgaaaggcttagtgcttttatacaagtcacagttattttaagaacagggaaaaaactcaaatctattgatttcatccctctctataaaactcccacaggtcaacaatttgtatttccaaaaacacagctggaatccaaacatctccttgtcaagttaacatatacatatggagctctgtttgctccatttactcctaatgacttagctacatgtgggtgccattcttagcctcaaacctgtcattttatatatatgcaaataatatgtataactatatatgataactaccattaatatttattagaagtaaaaaacatatgcctctaataggcaaagccaaaagaaagaatttccagtcctcaggtgatttttagtaggaagacctgctcacctacccaggtacttaagacaataggactctaagaaaataatctgttttggtccttgttcttaaaacaaatttcagtatcattttgggtatgttacgtcaattttcagattttttattatctactctggtttcaaaaaatgttttgttagtttttgctgtaacaaatgtattgtttcaattcactcttatgtgataaactttcaaaaagtgccactttggaaactgaaacaacacatagagtttatactaaattgtgctttaaattaaactagatgaaaatgagtatagcaaatacctaatgtggtcagatttactaatgaaatacagtaaacaaatatatttgtattttacttaattcagcatgattcagaactcataaaataccctatcattagcaattcagcacaaaacagatgcacggttctatcccagtaacctcaggttaatctttgtaattaaaacattatcttgtttaatgacaatctagttgccagtaaaataaggttaattgttattgaggcttgtgtttcagaataatagaggggagaaatttgtggatttgcagtcttcatggcaaatgtaactgtaaaaagcaaatagatgaaaaccctccaatctgcaaactcttgaaattattcaaatattaaaatttacaaatgaacttgcgatgtgtgcttaatttcaaaactccatggaaagatacaaatctgtgattagagaatgctggactgttgaattttggaggcagcctaacgcttagttgagatgttcacgttttgtctgaaaactggccacattgtgtgcacaatttttactttgtgataagcttatagcgctgctgacataaagaaaactgccttaaagatgataactgatacgtctttaagaaagtatgccataaaactgtgcatcattggtaagaattcacagaaagatctaatttaatttaatttcccgcttgctttaatcagtgtatctaatgataaaaaatagaagcacagcttttcactaactggaagatttaatgtcttaacaataattatcattttaattcactaccatatactattttaggcactttacataaatctttttattagtttatgagatattcttatctacagacaggaaaccttcaactcaaaatttctgatttgtgacatattctcaaagaagtgtttgtctcatttttgacaaaataagacaaataaaatgatacttgagaatctttagcatgtgctcataaccatgccaagtaaataacagactgaacatttggactcaggtttcatggacttacacattaagctaagcctgttctcgaaatgtggtcctttcaccagcatcatagggcatcagcttcatgctggaggtggactgccttcagcagtcagtagcttaagaagcccctcaggacctctgaatgattgcgatgctgtctaacttttgaccaccactgagctgttacatagatagatgcataaatagataaagatacagataaaggtcaatgttttattaaaatttgcacactcactatctgggaattttgtaaaaacagatttgtaggcccacactgagagattctaattccaagtctgaatataggtttcaggtggggtccatgaatgcgttgctcaggttccaggagatgctgattgatgctacggtccaagaacaacactttgaatggcactgccaatactgtgtcaggctgtaaagttcaacatacgagacccagctagagaaatggtaggctggtaggctaaaaattgaatagattaaggccgttattttgagggagaaacatgacaactaaattaaaacaagaatgatgtgaaagagagctcataagagtcacagaaggctaaactgcccaaaaaatgttcccgggcactgttgggcttgggagtaatgaaaagatttgcaaattctgatccagaacctttggcgtgcgggaggctcatagcttatcttccaggaagccctttactctatgaaccaatttcataatctctcttaacagttacctcatttccatagtggaaacctttcctgacttctttctttggctcaaaacttctaacctgtgaatgatgtacttccacagatgtgctagtctcttttgatatccaacaaaacatttattgaggaactcctgctggctactgttggcatatattatgttgattctggtcctgatttaactatgggttttgtcaatgccaattccttaaacatggatcttcgtcatttttaaatcagttttattccctttaggttgtttattggattttttaattcaactcacatttaatttcctttttcttttctatatatctcatgtggacttctttaagcatcagccacatcataaggataatggcatattgtttagaaacatattaagtaccttattggtacttaatggcatattaagtctaaacttaatggcatattaagtttagaaacatttggtacctcattgatggggttattcatttattcattccaattgcttgaaatatgtcatgaaagttctcattcctgccccttactcacagtgtatttggcaaaactttgaaggccattgtgttggaacaaacagaaagcgcaatattcgcattgtagttaagaacatcctgggtttaaatactaactttctcagttttaggtatttcacgttgcactgtttgcttagattctccattgtgaccaagagaatgtttatatcttacgactgtagtagggacatttaatttaataatttgtgcaatgcctttagtgcctactatgtgccagaaacgtaccaactactatgcctgctagttattatttatttaatgaagtgttgattcactgaactcaaattaaattatccttgctatccttgcctttctgttcttcatgccaggtactcagtgaggacagtctgcccatggcccacctcccaagggttgtcaattatgcaaatgagtcaccccatttagtaattagtaatgtttaaaaggaaagcccgggagattaatgcgatagcatacattacggttttggaattttaagcacagggcacctggttttggtaggcgtctttctttctttcctttctatttttcttcatttctcctctttttttttaattagccaaaccttcttcccattgcatttcatatcctctaatgtgaataactacttgatctactagtttgtttgtttgtttgtttgtttgtttgtacagccagcccttctggtgccattttagggaaagaacacagaagcactgcctaatgagtgaagtcatcacgatttcctatcacctttaattgtctgaagaaaatgattgagaagcagcaatcttcaaaaacaattgagggcaatcatgttgtcgaatttaaaatcatttctacttcagagaaattaaactttttttcttttctaacacaaaacagtaaatgaatcaaaaatccttttcttttttacccaatatattctaatgcttaatgtacttgcaatacaactttcattttctcaaaggcaggtcaagtgaacccaacaataaaattatatgttgtaaacctgtatggaccaactcacactttggagctcatgccacctgacagctttaaatcaaggtatgcaatttcaatttcacttttatggggaaatagatattttcactccaattatcattttgttgcaatttagagagagatgtgatcagctcaacaaatccacttgaaaataaagctgaagttgcctacattagtgaggaatgaagtcattctcggtctctggctgttcctaggaagcatttagctccaaggtgattatcagcaccatacaatgactgaagaggctgatactgagaattaggtcttttgctggagatgtgacagagatgggaacaaaagatcattttccactgaattttcttcaagaaaatagttgctccacattttttttgaaggtgttcattaaaagtgtataatctctctggaatttgtgagtttttccaactttctccccatagttttgccaaagattctctagctttcttctccagacatttaagaatttttttttcaaaatatcctatgtatgaaatacttatatttaagaaacttgatcagggagaaagtaaacacattttattgggtcagaagcataattgtaatattagcaaaatcttcagtagtgaacaactaattaaataatcatgtgtattttgaaatccatcatggtttcagacttcaaaagtgattctttcaaatactagagtcctttggaaatttatcacaaccctagagatgggataggcagctgatttagaaaaatgttttcacattatattgaatgatgtggggataagttcaaagtttattttgatgatatcgataatcagggtgattggttcccacagaaatttcattcaaatgttgtttcattgacattatttagaaaaaatttcatcccagttggtcattttcacagagagtgcagcctgatgtgtgtggaaattttacgtacttgaaaaggtaataaaggtttatggaatgcttactccagaagaccctcattaactacctaatataaacttctccttctactgatggaaaagataaatcccagtgagagtaaatgatttagattaggggctcaggactcattgataagaaaagtagaaaatgaagtaaggactctttcatcaggttacagagcatttcatccacgttggatggaagaccttaataataggcctgaattggcatataatgtaatacagttgaccaaatcaaatagtaacatttatttctgagcttgatctagcagccatgaatggttacgttacaaatgaaacaatgatggatactattgacattttatctggtccttaactcttatctttttctctggtttgtttaatgctatggaataacagaaaagggaaatagactaggagtgcttgagtcacatgtctaccaccatttcatttgtctcattggataaatcactttacctctctcagggctgaatccccttgtcttttttttttttttcttgagatggagtctcactctgtcacccaggctggagttcaatggcacaatctcggctcactacaagctccgcctcccaggttcacgccattctcttgcctcagcctactgaatagctgggagtacaggcacctgccaccacgcccagctaattttttgaatttttagtagagatggggtttcactgtgttagccaggatggtctcaatctcttgacctcgtgatccgcccgccttggcctcccaaaatgccgggattacaggcatgagccactgtggctggccccgcttgtcttgaaataaaatttctaatttttttcctttcaaaaaaagtttgcaatgggaatcaaatttacaatatccatgtttctttctaaaaggagctcttgattcctgaccttgattttttttacctatttgtataaatataaacatatataaattgaattattaataacatactttcttcatgtcctattaagttaatcaaatgtcctctcttctctttgatgtttgtgttgtgttcatagtatagctacctgtacagtttaaaatactgcctaaactctcaatagcagaatatttaaataattcattttataataatttacatgtttatgggttttttttttttagtatgttacttaagcatctggtatatttttataatctttaggttatctgtgaattgacagccaataagtgaatcatattatgtttctcagtacagttataaactatcatttttttcttttttagtacttttttccaccacacctaaaccacaaatatgatcatctcttagttttcttgtcttaataaaatcgccaaaatgactacaataataattgaatacatatatgattatgtctatataaggaggaataatagtaagataaatatagaaagatttttttcatgacttccactaccttataaaccagattctctgacctccacactggagaacaacatttttttgttgtttgaattgaagatcttaggtcctttttttggtctgtctgattgcttatttggatgattggtttccttatttataataactagtgtttatcactgtaatagaaaaagttccccaagctagtatcattatcccttcaacccaatacttatactcaccaaagactgtaaaatacattttaattaatttatatgatttagaaagaaattaaaaggataagataatctacagaaagacataatttcttctcctaattcttaccctcatagtctcttcaattgttttatttatttatgtctgattcagctgaagtcatttcatcaatttagacaatgagtgcaacttttcctcaataataattcagttcagactcatctcatcaccattcagtttatctttacctgaatcacagtctgtattgattctgaaaagaatgtagcatggtaggaactaagataatgcccctttttgaatatccccagaactagtgggagttggatgggttatctcatcttggaaggaagaaacattttgtcaaattgttgtactgtgcacttaaggtattgcaatcacacaatacctttattagaaaatttaagtgtgaattttaaaatatatatttactttccagggaaattttatcttatgataatgaatcatgaagattttccacagattggataagtcacattaatttggagaagtgatacgtggtcatttgtgtagacctctctagtctgaagagtaaaagtaatgatttgtccttggtttcttcttactctatgtccttagcattattttacttcttagaaatctttctgtagtcacttatcttttgtgacccattgttctcaacctgcatcactgatttaacatggtcattttgcccctgtgactctgggcttgacactgtcatgctttctctccctatttctttaagtatatctagcctacatctcttactcttccaaggagtatctgtgccttccaagaaaatctaattaataaattaacccatgttcatggaagtgtcctgaataacccttctgacaagtaatgcatagttattaacagaggtctttgtagaacgctagctataatttggtcatgaataccatcacaatatacttatgggaagacatcacagattatctagaagaaaatgagctcaaagtaactacaccgcacaaatattttggtgtaaacacagagcaatgattggacaggaaggccatgaaaacacggtgtaactgctaacatacctgtctgcaggtgatgctggggcctccattccacataaccttgtgtacaattagatcttctgtgccagaccacccagctgatagaaagtctgttgacttgagtgcaatccctctaactagcttgtctctgtctctgtggctcaagaggaccagatcctcgaggacttcctgggtaatccagagccatggagactaggaacaagcaggaaacccagttataagaaagggacacttctgctggccactggtcgtggaacaccagatctaatgtgttcatgagatggagttccaggaggacagctacatctgcagcaggcaggccaacgagtgtgacatttccaggtaagggtgcttccctactccctcattcagagacagcctgaatacttatgagtaagcaagatcagtcaatatgaatcacagggagatgtacacctaggctcctggggcaaggaaagaaaggatataggaagtgattgagttaatagatatatctttcctccctgcctatgtgtcaagctctacttgagcttccattttggctatctccaacaccttcatatagaaatttcagtggtttgaaatggtcgtttgttagactttaccaattaaaatttgtggagagctttcattcttcagattgtgtttaccatgtgcaaggtcattcttgggtataagcaaggtttgtaatgaggtatctcacatcagattatgctttgcttatgaccgtaagccacattatttaaaaacagacacaataatcacaatatttaatcaaagagaactataagtatattgctgtaaattaatgattttcaagttaacagtttacaactaagttagtgttcccttaaaaatcagttattcaccacatttgtactcgttggcttttcattcttttccaaagattaagttcttttttttaagtcaaaatttggcatcttagctaataaatatattctgtcatgcctgtgaggtgttgcaaagatgttcttgtagcatttcatttgagaccaactttgaaaaggaaagctctcaagatgaatgtttaaattctgttttgttgttggtggtatttatttttaaaattattcatgttagtttgttacctcatattgcacaaaatataatattatggcaggtaattgagacaaatttctgattatattagaaaagcaactatatatcagttcaatatagagtttaccaaaaaatatgaccttcttgattttgcagtctttggttagttgtttacaatattcaaattaattttttacttcaaatttcaacaacatttatatcaattattcagcatttcagcacttattttctgattatttatagtacttactatcatttttctataaactaaattctctagaaaaatctattaaaggttaatacttcattttctactttttaatattcacattgctaaatataatggtgtatgcaaaataatcggcttaaacgaaacacagtgaaagtgaacaggacactgttctttgcaggatcacaaggcctattgatatggacaaagattatacctaagccagctgcatatttgattcaatgttgccttattaactctacttcgggcactttatgttttgatttcactgagtttaaaggcagttttcaagcagagctcagctagttgtggcagctgccagatgtcttgaagaaattgttgaaaaaaatattacagccttccttgtatgtcaagttatgcttgcccttctactgacatcttcactttgataggctaacaggttttctagaggaaacagtagctactcggtaatgttagatatgtaacattcatgtagttgtatatctaacccagatacctctaaagacaggcaatttgtatcaagaggttatttttctgtagttgatatttttctaagtcatataaaactgggttaattaactgtgttttttttttgttgtttttttttttttgagacagagtcttgctctgtcgcccaggctgtagggcagtggcacgatctcggctcactgcaacctctgcctcccaggttcaagtgattctccagcttcagcctcccgagtagctgggattataggcatgtgccacaacacccggctaattttttgtatttttaatagagacagggttttaccatgttagccaggatggtctccatctgctgacgtcgtgatccacacgccttggcctcccaaagtgctgggattacaggcataagtcactgcacctggccaaaactagtttaattagttttaatacagtacattgatgacactttccgtgacacgtggatggctgtttcttctgagatcagatgagattgggcatgttcaggatggtatggctgtagactggatggctatttctaaagtaactgatctgttctgaaactgggcaagtttttagagaagtttttttaagtttttatcataaatggatgagtattgatgattgcattttgttgcgtgtgagttggaagctttgtgacatattgtatacctgtccaaatgtatgtgttacaaaggaagatatataaactttccaatcaccagttaccatgaggacataattggccccataaattatatctttattataccaagaatttaatagactcccatcttctttaatttgattcatttcttgtttaaaaatgtttcaaataaataagataattaacaatatggaaaaaattatgtattaaaaattgggactggtccttggtctacaactggcaaagaccaaaacaaaccattcataccttggtagccaaagtccccacgtatgaagtgaaataacacagaggttatgtataaaggatataattattaagccaggaataatctttgccttttaactggaagagattattcttgatgattcattgattgtgattttaaagaaaaaaataacatacctttataaatgtatacttgttttgcacttaaaggagtactaatcaatagaaaattttcataaatatctagcatgtcattgttttgatttttccaagaaatacttttctgggaaataattcactctcaaatttgttctcaaattatctgtatatttgtatacatatgtatacatccatgtgaatacatacatacacatatatttgtatttatatatgtaaatattgaaaagagcagatatctatttatctatctatctatacataaattaatatgtagcaacatccttatagtggttcagttattcttatatataaaatggcaaatgtatattgttggtactatatcaatgctctggctctaaacatacattttaattttgtttccaaactagagaatactatatcactatggttaaatgggtaagcaataccaagactgtggtaagatggttaaaccgagctcagaacatctccatcctcacagtctgtgagaccactacaggtgcttgtagtaaagtgagtataatttatttttcttttatgcctaaaatgaagtagcttatgcagctttacaaaggggaaacaggaaatgctttgtacaaaaaaaattcagtgtttaacttttaaaactaataggaaaagaattattctattaagaatatatactttaatttataaagcttccaaactttgaagtgaacaatattgatgataagcagaagagaacaaactgagcttttgaaaaccaaattaatttttatacagcatgaagtataatccaagccacgttagcttctttctcagatatggaatttttctccatattttgtctttgattatcttgagaatataagaagtttctttcctatcttctttaaacatattccttttaattttttctgtagttcagatagatctgataaaataacagtgtttctgtactgaaattaagtaaaacaagtaaaaaattggttcatgaactactctgttttgaaatcaggttatatttcaattcttaataccagtttttgtaaactctgtggtaaattcaatgtgtcatttttaagattcctggtagagaaaacactgcagtaagtttaaacggttatgtgtatggtatttgggtaaagcgtttttagattaacaactgaattttcaaacttctgttctggaaaagatggagtacgtgttacctgactagcttttctgttataaacaactgtaaaattgtacaaaatatacaaaacatctgttttcagatatgggacattaggaggatcatgaccataaatgctgaaatcaagtaaatgcacaaaatcaaccttgctatgactttctattcacaacacttttgagaccaaatggcaaggagatggagcccaagcaaagcaaaaagatttttgtgatctaagcagacagggagaaccagcgtttgaggctttttttggtgactagcatttataggacagggaccagagaagttggagctttatagaaaaggactccagcaatctatggagaggaccccttaagtattaggctcaatgcttagctgtgcatacctatatgtttccacactgtcttaaagaaaacaactactaaaaatttttgaagcaaatgaagaatctgcaagttgcaaagtacttagagacgttagagttctgaacaacaatagtgaagagatctccctgaaaaccctgggtattcaactgagaacccagaaagaaagcacattagaagtagggctagtctagacaccttctaatcacctttcaattacactgtaaggtatcaagttcatctgtctgtaaattaactgtctactaggacaaagtgtacatttttaaaggggaaattacaattgataaagactatcaacaatgtagcatttataatgtcaatcatatgatcaatactatatatgtagaaaagtggaaaatataacctactcaccttcctcaaaaatatccagtaaaagctgacctacaaaggatagtaatattggaattagcagacacatgttttacaagttattagaaatgataaatgttggaagtgatggatatcttaaatacactgatttgattattgcaccttgtatacaggtatcaaaatatcacatgtactccaaaatatgtatgattattatgtatcaataaaaaattaaaaatcaaggtaaaagttaagtacagtgaagtgaagaaatctcacatgtgcagttaaatgagttttggcaaatgcatatatcccgtaattcacacctcatcatgatataaaacatccctattatcccagaaagtttctttgtcctctttttcaatcagtctcagttcccagaggcaactactattctgaggtctattataaattagtttcgcatgtttttaaactgcatataaatgcatttatacaataacaaagttattagaaataaatctaacaacttagaatagctccaataaataaacaggtggaaattttagtggagaaataaactttaaaatgaaactaaaatttcaggaactgaaaaatacaatgtttgaaatgaaaacattgaatagacaattcagaaataaatacatgtgtttatagtgaactgattttcaacaaatgcatcagaacagatattagggaaaggacagcctctttagtaaatattgctggaaaactggatgtcaatgtgcagaaaaatgaaactagatgtgtatctctcaccatatacaaaattcaactcaaaatgaattaaaaactgaaccgtaatttccaaagctataaaactactagaagaaaacagagaaaatgcttaaggacattggtctaggcaaagattttatggctaagacttcaaaagcacagacaacaaaaagaaatgtaaattggtactgctattatggaaaacagtatggaggtttctcaaaaaactaaaactataattaacatatgttactagcaattctactactgggcatttatccgaaacaaaggaaattagtatatgaaatacacacctgcatctgatgtttactgcagctgtgctcataatagtagggatgtagaatcaacctaaatgttcatcaataaatgaatggatttttaaaaaagcatacatatatactttttaaaaagtatatatgtatgcttttttaaaaagtgtgtgtgtgtgtatatatatacataaaacattccattgtacatatacaatggaatactattcagccataaaaaagaatgaaattctgtcattcatggcaacatggataagtctggaggacgttatgttaactgagataagcgagtcaacacaaagataaatatcacatgctcttacgtctatctgggggataaaagaaattgcacttatagaagtagagagtagcattgtgcttataagagtctgaaaagcttgggaggaaaggatagagagaagttagttaacagatacattacagctagataagaggattaagttctagtgttctgaagcactgaaggttgaatgtggttaataatgatttagtgtttattttcaaatagctagaaaagagaatgttgaatgtttaaagcacataaaaaatgataaatgtttgaggtagtggatatattaattatcctgactttgtcattacacattttttacatgtatcaaaatagcactctgtatttataaatatatacagtaattacatgtcaactaaaaataaaaggaaaatacatcaccaaagtgaatgtatgaagaggaagaatatttgaataattttacatcaattaaagataaaaataaagaatgaattaaagataaatttatttagtaaattacataaatttaattcataattagaaaccttgccacaaggagaactctagaagcgggtggattgcatgatggattctatcaattattaaggaataaatcctgtaattccttgtcttggtttgttttgtgctgccataacaacctaccacaggctgggtagtttataatgaacagaaacttattgactcacagttttggaggctgggaaattcaagatcgagaggttggcatctggtgagggacttcttgctgcatcatcccatgacagaagggcaaagagagggtgagagagagagaaacaaaaggaggctgaactcgtccttttataaggagcccactcctgtgataacaaacctactcccataataaagacattaatccattaatgatggcagaaccctcatggcctaaatactccgtaagattttacctcttaatactgttgcaatcacacaatcacaattaaattttaacatgattccggagtggggagcaaatattcaaacactgtatcattctttctaaggagtatatgataacatccctgtactccttagaaagtgaagaagaaagagaacatttcaactaatattataagagtagaataatactgataccacaactagacaagaaaaatacaagagacaacattttagactgatctctctcattaacacgtgtaatagtctgttttcatgctgctgataaagacataccgagactgggcaatttccaaaaaaaaataataataataaggtttattagacttacagttctgcatgtctggggaggcctcacaatcatggcagaaggcagagaggaagaagtcacatcttatgtgggtggcaggaggcaaagagcttgtgcagggaaactcccactgtaaatccatcaaatctcatgagactcattcactatcatgagaacagcaaaggaaagattcgcccccgtaattcaatcaccttccaccgggcttctcccacagccatgggaattgtgagagttacaattcaagatgtgatttgggtgggacacagccaaatcatatcagcacaaatatgagaaagtccttaaacatatcaatactcaactccagcaatataaatagaggatagtgcattgagatcaaatgaggttaatcccaggaacttaagattggtttaatattgaaaaccaatcaatataatatattaagaaaaaaagaagaattaaatatcttggtagatgaagaaaaagcaattgacaatattcaaaaccaattcacgataactttcaatataaatgaataacaagaaacatccccaatctattaaaagatactcataaagtacccccttactgaatgtgcaaacactcaccttattcatgttaagattagcagtgagataagggtatccattctcagtactatcaagcaaactttaccagaggccccactcagagtaatttagcaaggaatcagtatagtgttaggaaaggaagaagtaaatctgtatttatagataacataactgtatacattaacaaaaaagcctacaaaaaaccctagaatacaaaatcacaatttgtaaggatgcaaatggggtaaaatataaacaagtggcaagtaagtccagagggcattcaggtttctcaaaccagtcttctaacttttgtctataagtttgtacttgtttcaaaataaagaatgaagaaacaacaaaacataatttctaaatgttagtgatattaagaaaaaaaatcagttaaaataccactaaaacccttaaaactttaaatacacaattataaacttaacaaatattgtgaaataccccaatactgaatactacaacattgctaaaaggcatttgaaagacctaaataaatggaagctattccatgtttttaaatagaaaaaattaatattgttaagatattaattctacccaaatttaaccataattttaatataataccaattaaagtcccttctgattttttttgtagaaacagacaagctgtttttaaaattaatatggaaacaaaaaatacctgaacaagtcaaagtaatcctgtaaaagaataaaattgaaggagttagccctacctgatttcaagaataaataaaaagctacaaaaacctggagatgctagtggaggcataaggaccacaaataggtcaactaaattgaatggtttgcagagaacagacccacatttatatgattgattgattttctacacaggtgctaaagcagttcaatggagaaaaatggtgctgaaaaaattggcatcccgattggataaaaaaaattgatgtttgacaactcatatcatattctaaaatcaatttgggataaatcatagccctaaatttaagagctaatactgtcagtgttctaggggaaaatatgaaataaaaccttactatactgaataagccaaaaaatcattaattatgaaacaataaattggacatcaataaaattagaaacttctcatcaaagacaccattagggaaaaggatatgcaaactacagtctggaagaaaatattttgccaaatgggtatcagacaaaaacacatataaagaaattctataactcaataataaaaacacaacctcataaaaacatcaaaacatgtgaacagttacttataaggaaaagaatgaacatatgaaaaagtactcaacatttggtcaggtatggtggctcatccttgtaattttagttatttgggaggctgacatgagaggatcttttgagccaagagttcaagaccagcctggacaacaaaatgagatcccatttctatataaaaaaaaaaaaataaaagcactcaacttcattagacattagcaaaatatagattaaaattataatggtatattatacataattagaatgactacactaaaataacaaaaaactgacaacattaactgttaaagaggacgtgaaaaacaaaaattctcgttctttgcaagtgggaatgtaaaatgatatgattacattaaaataatattttagttccaaatgaagttaaacatatgtaaacacaatttttttgtttatatataaataagaagacatatatacacacacacatatatatacacatatacattcatatataaaaacacattataggctgggcacggtggctcatgcctgtaatcccaacactttgggaggcggaggcgggcagatcacctgaggtcaggagttcgagaccagcctgactaacatggagaaaccccgtccctactaaaaatacaaaattaaccgggcatgttggcgcatgcctgtaatcccagctactccagaggctgaggcagagaattgcttgaacctgggaagtggaggttgctgtgagccaagatcattccatttcactccagtctgggcaacaagagtgaaactccgtcacaaaaaaaaaatacaaaaaacaaacaaaaaaaaacccatacattataattccattacaaagtatttgcacaagaaatgaaaacatgtgttcaccaaaggatttgtaagaaatagtctgtagagaagctttatttacaatagctaaaaagtagagactatttaattgtccactaacaggaaatagactttaaagtaagacttatctacacaatggaattctacttggccatagaaacaaaatactgatacgctcaacaatatgagcgaatctcaaaaacaagtggtgtggaagaaacctcacactacagagtacataataggtatgtaatgcatgatttcaattatctgattttctaacacaggcatatgctgtctatggggaaaaagatcagaagtgattgccttttgagaacctctggggaggagcatgagttaatgttttggggaaaaataaagatcctataacttgatgggataaacttgtcaaactcatcacattatacacttaaaatctgtgcatttcactatatgtgaaaaatttaaaacatattatttaaatggtctgtgaaggagagccctcaagaggcagacatttctctttgagtagaatgatgagcatagtcgtggaaatgagatagttaaatcaaccacttgatgctcttctcattaagcttgtattactagaaaattcatctctttcttttggctagattatagattgactagaatttctccacgtatttgttaaagtgttctggatggtttttattcggctgattagtaagtcatttaaaaattggcctacaggccggctgtggtggctcatgcttgtaatcccagcactttgggaggccagtgtgggcagatcacctgaggccaggagtttgagaccagcctggccaacatggtgaaaccctgtctctactaaaactacaaaaattagccgggcatggtggcacacgcctgtaataccagctactcaggatgctgaggcaggagaattgcttgaacttgggaggcagaggtttcagtgagccgagatcgggccactgcactccagcctgggcaacaaagcaagactttgtctcaaaaaaaaaaaaaaaaaaaaaggcacaggccaggcataggtagctcacacctgttattccaacactttgggaggccaagtggggagaatggcttgaggctgagttcaagacctacctgggcaacataatgagacaccatcttatttttacataaaaaattaaagtaaaaatttaaaaattagcctacatatattgtagttagagaaagcccttctagacaaagatactgtaaatatttcattgcatacagataactgcaaagataaattaaaatgctttaatagaaaatagatccagtaatcctatcatactattgatctgacaccttattgatattgtattttattctacgtatggagataaaaagactttgcattctgttaattgaaataatgagacaaacaataacaaatgaagttttgagctctcaggggttctaccaaaacttggtggtactaacaagcagtggcattggtatctattttatttctgtgctttacagatatcaagaatggttaatgctagggtgtaaatggagaataaagaaatgattcagttagattttttttgatatcttcacgtaatgaagatctattgaaaaaaaaagtgccctgaaaagagaaagtgaccaattataatgtaatcataatatggatttagaaaaagaaattagtatttaaaaacatataaataatttattattaacaatttgagatgggtacctctgcatataggaaagcccctaatatgttgttacttatctttcttaatttgaatacgtttattatagaatcatttctttcagaaaactgcaagatatttcatgtcattacatgtaaacggtattattaaagcttgttttttctacacatatttaacgaggttaaattagtctaattttgctttttgcaatatgattttggctctgatctactgcaagactgttttgaagggacacataattttgtcatttcaaatgtttgatattttttctcaaagactgagttactactgataagaaaaaaagaaggccatgattatgagtgaattgaatattgaaagaatgtccactttttagttttattcctggctgtttgcccagttgctttgaaggacttaataattttgtctcccaatgatgcctagaggtgaaaagagacagtgtctggtggttcaaaacagttgaatgaggtaatcaaacagagctggaaaatgatcttctctccctggtgaggtactgctgggaattctgaaagaattcaccaaagaaaagactttataattaaattatcgtttagtccctattctctacttactcattcagattaaatcaataatgacaatgaaatctctcatggtgtttcaccagttgaagagagggaaaaaaaactgataaccgtgttttaaaaaagttaaatttatatatgctcattttggtctttagatgcttcatggagttaattgttttgtttcagaaatatgagatgacatcagatacgtggctctctcagcaggtacagtataggtggtctgtcacatcttggccattgtgaccatcctgttcacccattttttatgtgataactttctgtaaaaagtatgagtttaaggctttgctaggtttgacagagtgatcctttttcattaaaaggatcacttatgacttgggctttctatggtatcatttgtgaaaaggttacttccatttttttaggagacataaattgcagagtagctgccaggatcactttttaaaatattctgtgtaagtacactcttgtgtagatgaaggagaaaaactcaggacctaaccaaactagaaatcattagcattgttcaaattgtctgaaaaattgacctgacctttacataaattgatcatggagatattcaaataaatacttctcttcttagttgtattctagctcacaattctagtttgtgacataaatgaggctggaatcaagatgaacatgacggactaaaaacctaatcactgttacatggtctcatcctggacaattcagaaggaaacaacacaaatagcttatttaaatatagctgaattcattttactcttaactacattagtgagttttgcaaagggaaataagatgtgtggtatggtttggtttggttttctttttgttctttaaagccctcttttattttatattacgtctatggcgttaatgaccacccatattttgagaccttcacatttatccagacacttcagtgagttctgaaatatccaaatttatgcttgccatctcctcctaaatctgtaaaagtagcttcatactccccaggtctaagctgaactcattccttttctagtcagtcttcttaatttttatcttaggactcaatgacataattatccattcagatgttaaaactatttacctaatagtcatccttgaatcttttctcatttttatctatctatatataattaatatgtacagattttactttcaaacatctctcaagtcaatttacttttctctaattcacaaacactgtccatgttcgaactacagatccagcaagtctcaacccctcaggcacctgccaatctgttcacactgcaggctaactgagtgacctttttaaaatatgcatttaattgttgctactaacattcccctcatacttgcacttccacaactcaaagaacttttctctcttctttctgtccttcagataaagaccaacatccttaaaaggtccacaagggattaattgaaagctttttcagctctgagtcatagaatcatttgatctgttttctccagtctagctacatggaccctcatatgcacagggacttcataagtgcccttccttctgaacaaaattccctcaaactttcttatatgaagcctatttatttttcaaaccttggcttaaatcacctatgtaagaagtcacttcctctaactagcctaaccaaatcacatctcccaataaaagttatattaaagtcaagtgtaatctttgtgtaacacacaattattgctatgatttttttttttgctaagatacaaggacatgaggatgttttttacttctaattgtaaaccaaacgcctagtatagaattcaatatgtaagaattcaatatgtaagaagagcttaatagatacttactgagtgattaagaagaaaagtaaaaaggattataaataattgtttgtctgaagggtaggtagatggatagacacagataaatgtttgtatatatattacgagtatatgtgtctttgcacatggttatctattaatataaatacttttatcttggtcaatgtacaaaataaaatagaaaaaaaaccctgattttacagctaataatagactcacaaatttcggttagatacagaaaataagaacaatggacaatatataacacataatacttatgcattctgaatttccctccattattaaacatcttttgctattactttgattgccagtgacattcataatagtttaacatatgtcaacataatgcatgttcttttgagattatgctatctaatttttaaatcccaaatttatgaatgtttaatagaaacttttttaaaaaacaaagcatccagttattaattattcagttagtaaatgccattggtcgtttatcacagttgatttttttcttcagatgctctaagggaattttatgaaatacttagagttatatgaaatttaatgtatgagcatggtagcagtaataagaagcagcaaatttctaagataattataaatttaatagaatcatcatatactgtctttttgcatagcagaaaaggcaaagagaagtaggcatgtttagcctagctttcaaaggacttgcaattgagatgaccagtgtgtaatatatttggtcaagggaatagagtccaatatccccagcttaccatcttgtgtgtcaaaaacactgacttgtataatgtcatgaaactgagcagtgagattggcaccatctgtgtggagctgaatgtttatcaccagacattgtcaagtgttgggggcagattttttagtccagcaaggcatatgagattgtagcccccatctattccttttctgaactacttctaaggtactagaactggggaggaggcaatgtaaatggaagaatgcttatatatctgtatatgagaaaaaagctattcatcttttgatagaagtacaaagggagaacggtaagggaggagttgctatgtgggggtaaatctggtggatagagtgatatataaaactaatatttttgttcatggtatccatatattcatctattcaccaattatgagttgggacctactgtgtcttaggcaatagagctaaacagataacatttaaaatttagttcaattattaattgcctagtgaaggaagccaacaagttaatagatcaatataatagagtgcattggaagccatgataaagatgaaaacaagatagtttttagaatatctgaggagagatttcctaactagggaaatcttggaaattcttttgtttcatgagaataagtaaaaaatgagtaagatttagcagaaaaaggaagacgaaaaagttgttccagacaaaagaaactccaagagagaaatatcccacaggagcaggtgatggaacaaatagaattattgactttattatagttgaaagaagtgattcactcagtcaagtattttgtcagtatccattatatgctcagttatacaatttttccaaccttgaatggtatattatctcagagttttaaatttattacatatgttacttatattttcatgaatgttcataaggcagttaaggaaaatatccttattttactgtcaagagatgtattgtgaatgaagctaaaatcaaactgttcagtatattaaaatagttattaattgactgattcattcagtaaataattattgagctcaatttacatgatagtcactgtttcaggtgctgcagatgcagtagtgaaaaatacaagtttcctgccctatggggcttacattacagagaactacatacatacatacatacataagtatgtaaatatgagattagtgcaaaagtaattgaggtttttgccattacacggtaggtcgcaactcataattgatgaatagatgaatgtatggatacaatgaacaaaaatactcattatatatatgtgtgtgtgtgtgtgtgtgtgtgtatatatatatatatgtatatatatatgtatatatatatatatatcactctatccaccagatttacccccaccattaaaagtaatggaaaaaacctcaattaattttgcaccaatctcatacatacatttatatacagtatgtacatatgtacatacattcatatacatattttgccattaagagtaatggtaaaaaccacaattacttttgcaccagtctcatacatacatacattcatatacaaacaaacgcatacatacacaaattatacgttgaatggtgttagttgctgtattagtccattcttgtactgctataagagaccaggtaatgtatgaagaaaagaagtctaattggctcacagtactgcaggctgtacagaagcatagtagttattgcttctagggaggcctcagaaagcttccagtcatggcggaaggcaaatggggagcaacacttcacgtggcctgagaagaagcaagaaagggatgggggaggtgttatacacttttaaacaaccaggtcttgtaataactcattcactcactgtcatgagacagcacccagcggttactgctaaaccattcgtgaaggactcacccccgtgatccagtcacctcccaccaggccccagctccaacactggggatttcaatacgacatgagatttgggtggtacacagatccaaactatatcaggtgctatggaaaactagaaagaaaataaaaggagatgaaggatgtcagatagagttggatggtctgactttcctgatctcgctttatatagggtaataaggaaacaccttattgataaggagatttcggattagagacctgaaagagataagaggaagatccagaccaagggaatacaaagtacaagagccctggagcaggatcatgcaggaacccagtgaagaaagcaagagaatgacaaagatgagatcagaaagacagtagagggccaagtcatctaaaagggcttgaaggccattgtgcagagctactcaggacccatatcaaagcctttctttataccatatataaccacctctcgttagtccagcaggaaaaactcaatgtttcatcagataaatgtgttttcttaatgtttttcctgaagaaagagcagtatctctctctctctacatacatatatgtgtgtgtgtgtgtgtatatatatatacacatagtgtgtgtgtatatatatacataaatatatatagtgtgtgtatatatacacacacataaatatatagtgtgtgtgtgtatatatatatgtggctttcatcatttaattttcaaaaataattctattgatttaatgtgccaccagagtgtaattaaaaattatcaaatggggtcacagttgtaggtgggcatttgtgtttgtgtgtttgtggagagatgagcaataaggatggtaaatttgaattaaataactttctatagaatcctttcaatttcgtggcctgtcgtcttttgtattttcagttaatttatgaatacattatcagaaaagaatcttcaagtaagtacagttgctgaagaaaggatttcaaaaaatatgttacagaattttgtaattaaaagatttattttgataaactgatgcagatgtttgcatgttctttatctttgaaggatatttcactaaacacaatcttatgtgaagatatgacagttcttgtttgaaccaatttaaaaagtgtctttagtctgataataaatcattcatatccaccatgcacaaatttctcctatccttcccacaactcaaccacatacatatgtaatgtatcagatttactttaaaaaagtttaaaaaatagcatacattcatttttttaaaataatgtgcccattttcctaactaattataaatcaatatttggtataacccatgcaggaattaacagtagtaggcagcacagattgcatgtgcctttctgagattgttctgtgctcttctgtattttagaatgaggagcccgtgttttctagagacggcagcaaattctttatgacagtgcctgttaagcaagggggacgtggagaatttcaccacgtagctatgttcctcatccaggtaagtgctggcttttttccatgttttgatttcattgtcctcatgtccccgaaggcccagttcttgtggcattctaaacctctagttcatggtggtgaaacccagccatatatacaactcacagacatcttaggaagaggacctccatccatagccatacattcaagccttaccttcccacaaaacagtctcaacactcagtacaatttaatgagttacatgtgtgtcctatgaactgagggctttgggatagagaatttaataaattaaaagcacccaacttttgaggacctgagataatctagagaagattttttattcaatgaacatatatataacctattttgtacaagtaatattctccaggtgttataaaagttttaaatactcaaaggaacctaaatgtccatcaaaaattgatggttgaataaattatggcacatccccacaagcaaatacagtgcagatttttaaaaaacaggataaaatagatgttttatgttaaataacatagatttcatgttgtaaaatataatctatgttttttttttagactttccgataaaaagaggggaaaggttactttttatctaatcaaaagaatatgaagggtttatacagttttattataaaaaaattagtaaattcaggtagttagtttaaatttgacaaggttattgagtcaatctgaatttaatttccaagagcaagcatacatgagaaaataaagcatccttcaaaatcatataataaataatctagtctcacacacaggttaaaggctttctaatgaaaagtcactgtggctaaactgggatcttcatgagtgttttacaaactagctaagagtaatttcatacttacaaaatatagaataaatataaatatggcaaagatacctaactgaccttactaattttatgtttttagaacctttaagacctgtgcacattctcaaatgattaccattatccatatacatttgtattggacagcttaatgctttagagtctcaaaatcttatgtcactaatttaaaatttaaaacttgttcagggtctgtgtaattaaaatagttgtcattgttttaactttaattttaattacgactgaaagaaataatttggaatacatacaatttccacagtacagatgtagattgattttcatagtatattattaaggtggaaaaacaggttataaactaatgtataatgtgatcctatttatgctctaaataaatgcatttatagatgcatttatatatgcatttatagatgaataaaattttggatgtttttatatctagctattaaaatgattatataagtcaggtataattaagggaactttttttatgaaactgaaaggaaatagactagcaaattactttactttataaacttttgctaattaagagtcaacttggttatcacaaatattagagaactattttggcccctaaaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtgtttactttgttcctcttctatatagggactataacacagccttcattgaagtagaaaacattttttttctattctggttgctgtttaggtaatttgtggtttgcctcattgagaaatgaacatgactgcatgattatttatgaatattttggcaattgattaaaattagtctactttgctaatgagtcagaagtcagtgctaggtaaatacaatttatacataactttgaacacacacaaacacaatcacatatgttattttaggaaatggtttgaatcaccttgcctcaatttaaaaatagctaacaaaaaagctatttatgaattgtgtatgactgcttaattgacatatatgcactataaaattctgaaaaattcaaacttaataaactgataaaggagtatataaaaatcacccacaatatcatcacctcatattctcacacttttaatccattattgtgtatattttacattcttttttcatgagaaatatatgattttcccctaaagattgcaattaaagcataatatagatttgtaacattaaaagaataactaatgagtgttttcttacaacatttaattgtattcctaatatttaacattttatatttttcttaaatgtgattttaatagctgctcagcattacagcaagcagatatactgtactgtatttatttatttatttatttatttatttattttttgagacagagtctcagtttgttgcccaggctagaatgcagtgacacgatctcggctcactgcaaccccctcctcccaggttcaagccattctcctgcctcagcctcccgagtagctgggattacaggcacccgccatcatgcctggctaatttttgtatttttagtagaggcgggtttcaccgtgttgcccaggctggtctcgaacttctgacatcaggtgatccacctgcttcagcctcccaaactgctgggattacaggcataagccaccacgcccggcctgtactgtatttaaatgatccaagtttattcatcattaaagttatttctatattttgatgttagaaatgattcagagttaaaagcccttataaacactttacttataattcttcccgcaaaattatatttctagatgttaaaagatacccaggcagggtatatccatacgaatgtatttgtttaggttttgatgtgtaatgccaaattggctctccaaaaaatagtacaaaaatttactgcctaaacagtaatgcatgccagcattgatgactttttaccccctttccttcccttgctgtgctacatgattctacttaaagttgtcgtgcctgaaaagtgagaaatgacaggactggggccttggcagccaacagtcagccaggtcacctttgcagtacttggcgcttacctatgtttgagagcttactagttcactcagaatatatttatttgcttgaagtaccttactaaatgaaattactaaatttttgcaaacattttgctctctcatattatcagtaagtagataaaaatcattaattagagaccaagctagacaattattgatttcaagctattttcattatggagagtgatggcggtcactacatatattttagtgggtttttttttttcctcatttacaagagctgtccttgttaaagtgattccaaaggatacaaataaaaagagaaaagaatgcatgtgttttcctccagtcttcatttaaacattattgtaattttatgtaaactacagtattgcatcctgatatgtcaaatttaaattttaaatgcacacttttcccacaatgctaaataattttgaaaaataattctttagaagattaatattgagttgactggatgtgcatcaataaccattatttgttgttctgtgtttaatttagtggcaatttgttgtaatgatagatgtcactgtatataaagcttatttatattgtggattatttctttagtattgattaacaaaactggaatagctggaccaaaagtaaaagatttctaagccctaatatatgtatttccagatcactttcagtatgaatatatgaaagcaaaatttgtgagtgttttctccactttcatatattccattaaagaaaatattaaataaaactatggcttttctggaaatctatatagctaaagaaactgttcttctggatagagtgttttgtacacgtattactatcagtttatgtacttcctgagtcatacactgatacaaaaccttttaccccagaccattaaacttttgatcacttcagatattcgcccctttgccccttgaaaaatatttgttatgttgacttcaaacttctgaattctcatctcaggaactgtaacattctacatcctgcaattcaggctgcagtgaagagataggtttttatcaaaggtatagcacctttttctctcaaagatggagtaagcagaattttcattgtgttcagtcgttcagattcataggcgtaaggaatggccctgtcaccttctaaaattgtgttaaatgaaaaattatatgtgggtgaatccattcactttctctattcagcaacacgaagttttgcccatgagagctgatgatttcacttggaacgattttaagtggcattattcactacaaatactgtggaaaacagcatgcccccaatccacaattttatcacctaatcaacccagtaaaatttttgcattaagtttcactgctgcatctgattaggacattgtctgaaaacaatgagctcatctcatgtggtgaatagatggcaaattaaagcatgctatttttaagcactacaatatttcccttatttagaaactataaaagtgaacatttaatataagaaatgtgaatgaataatgtgtaattaggtaaaaagaacatgcagggttaaacttgtattgatacccaatgtgtttccaatttgtaaatcgcattataaaaccaatatttaacttccttgagcaagataaaatctctatgaattgaaggtcacttgtctggtgtctaatgctccaaataaacactctattccaaatttccagccctcttttaagaatgaatgagctcacgacttttgttgctttttagtctgaaattaaagttgaaatattagttcaatttaaaatacattgtcatactgcctttatcaaaagtctactacagttttatatttatattcagtatttctattctaccaagttaatattgcagagattatggattcacagaaacaaagaaatgttattgtagagaaaaaatgctgttctttcctgctttgttaagtgatctttcctgtgattgcatttctgctgaaggtgcttaaaaacctaactgaagtacaaacatccccttgtgaaatctgctcaaatactgtgatatttattaagtgttgttcagtcatctaccatattctgattggtattaagattattagccaggtcaaaattaatgtgctcactgctgtgacagtcttatgtagattattagaaagtaaatctttgctattatatgcaaaatgagggttcaacttgttccccataccatatttgccctggtagattaaaagcaagcaaggcaattacagctgtttcaaataaaatcaaaaggttatatggttgttattaaggcttccaacaagagatcttttggtcctacacttgaaagtgtaatattttgaactaaaaggatcattgaagtaaatcatatataatattttttatactgtgttcaaacatttttcaaagcattgggtttttactcatggcaattttaatgttgtatctcatttgtctttaaaacacacatacacacacacacacacacacacacacacacaccaaaatactctgaaaaacagagaaaataattaacctagaaatctgtgggccaaaagtgtctccagatgttttcaaatattgagcaaagtttcttcacttttttaatgttttgagattattttatcttgaaattggcatcaaagatgcactaaaaccttgaaattttagtatcctgtccttggctcattcaaagcagggcctggaaacaagaaagaggagctatccactgagttatttgcctgtgtgaacttggcaataaaatgtatgactttagaactctgtgccagcctttgggttatgcagttctcatatctcacaaattgggtgtctttgcacttatacctctagtcaacaaatacttgtaaatcagtagtacgtcagatagtatacaaagaagttgatataaagaagtcacaggcttgctgttgaccttaagcagctagacgtctagagaacttccactaagaacataaaatagactacttagggagatattgaaatgcaaatacataccaataagacagaaaatttttcaaaggaagattctgttagtacacatgtgcagtaaagtatggaatgcccttttagtttacactttcagttgtgtgggaaaatagatgttataataaaactatcctatatgaacctaattctgaatttatttttaccaaaaatgcattgaaagcattactcagctgacagattacactctctgaagacaatgaaattgaattgcacaaataacaacatttaaaaggttatacatttggaaacaaaatataatttctattcatagtttcaagaagaaatcagcaaacacttagaactaaatgagaatactacatatacgaaaatatgcaatacatataaacaacagtttttaatatatgcaataattttatatgcatatatgaaattatgtatatatccaatgtcagaatttagaaaaggaagagaataaattcaaatgtaaaagaaaggtaattagaaatgaaagaatagcacttattaatctagtaagcaaacatgaaataaagcagtatgataaaacaaatagtaagttatttggaaaaagtagttgaatctataagagctgtcaagggtaataataacttggacagttccaaagtataaataatggaaagggacaaaactacagattttaaaaatattaaaagaatactatgaataactttacattgataaacttgaagtttaggagaaatggatgcaatctagaaaaaaaaatcaaatcagatttaagaaacaatcaaaatcctccatagtgttaagaaaatggaatcagtgatgtaggattttccacatcagggaaaggttgtttttaaaagtgaatctcaccaaatattctaggagtacgcacttccaattttatattattttgaaaatgaaaaaatatggcatgtctttagtacaatttatgacatgggtatcatcttgtaaccaacacgaaattaaaacagtatcagaaaagacagtataagaaagcttaaaaatactaaaccaattattgacaagttgacttatttaatgcatttaaaaaattaactcttattttttgaacagaaatgcaaaatttacttaaaatttcaaaaatatgtaagataattaactgcatttaaattttcctgagaaaattataatcaccttaatagatgcagacataggatccaagtaaattcaacaaaatcagtattcaaaaaccttagaaatttaggaataaagggaacttctttaaggtgatgaaggcacttgccaaaagctttattcatatagcataattgataatggagcagtagtaatattccctttaaaatcagcactgagataaggaatcagagtgaagtagcttgagtatacacaacactagagataacagttgtttttgtttttagctgttgttgttttatacttgaagctctggggtacatgtgcagaaggtgcaggtgtgttacataggtatacacgtgccatggtggtttgctgcacccatcaacccgtcatctacattaggtatttctcctaatgctatccctcccctagcccccaacctcctgacaggcgccattgttcagctcccacttatgagtgagaacatgcagtgtttggttttctgttcttgtgttactttgctaagaatgatggtttccagcttcatccatgtccctgcaaaggacatgaactcatcctttttttacggctgcatagtagtccatggtgtatatgtgccacattttctttatccagtctatcattgatgggtatttgggttggttccaaatctttctaatccattctaatcagtgttctctaactacataaagtggttaaggaatagaatgatagtatttctaagaatactttttgggtcaaacaatatatattttttagacaatactactacctgttttttacatattaaaatgttggtcctataaacaccttggaagcattgattaagctaattaccttcatcaacatgaattcatctctgaaaaaaaattattgcattaaatggcaaatcttataacaatgcccatactgcaaaggttaaaatgaatacaaacctgagtatttattggagtaaagtttgttctaaaatgttttttttttttaaagctaactgtacagctgccagtcatttacatgagagtgattaaagtcctaccttggaagcaaatgctgccatcaacatggtatacttgattcaccctcacctggaggagttttctgaatgacttttctatagttgaaatgaaggcactaacctacctgccttgatctgtgtttataggaatgcatgttcattcttgagctgtggaacagaaaactgagtgttaactgagaattagagaattcgaagtgtcacaagcagttggtacattcgtgtttaccagagagatgctgtttaaatgaaaggaaaatcaatattttctatttctttgcagagtaaaagtgagcaaattaccgtgcggcatctgacatcaggaaactgggaagtgataaagatcttggcatacgatgaaactactcaaaaaatgtgagtgttttcagttctctagtcaggctgcaagttagcgttgtcaaatgccatcttttctaatagaattatgttttgcttaccatagtcctagtcaaaacaagccagccatggaaagaataacctttctttaaagacctcttccacacttcacacagagacatcttacacagagggatgtgtgtgtgcacacgcacacacacacacatatactcacacacagtgattgagagaggttatgaaaaaggatgattttatcaggggaaaaaaatatgtttcctagtttgatcatagccctgtgtttgtatagcaaaacaactcctgtctgtattttgacagttttaaaaattcaagtgaagatttaatgtgaaaattcaggtgaagattcaatgtgaattcaggattcaatgtgacaatgtgacaaaattcacagatcacaaaaaatagatctgtgtctaatgcttgtgttgttttctttcctggacagttactttctgagcactgaatcttctcccagaggaaggcagctgtacaggtaagcagtgtgcaaggatctccttacacagattggcttctcaatggctatctatgtagcataaggaaggaaaggaaaaatttgaaatgtctttttcaacatggctaggaagagccaactttgctgacaaagcttcacactcttgcaccagtctctcccttgacaggactggagaaaatggagccctgcttgctccttcctgctctgcagcctccttattcttttcttcacctgcttttgcagtttcttaatatcttttttgtggcttatttctctcaactctccacatcagagagatttacgtattttccctcgtgccttcatcttctgctaagtctcattttgaattttcagtgcattaatgtggcacaggtgaaatttattcttgtacaatataatgttgttgtgaacagttagtctagtgtatcaagcaggaagctttccctctttgtcttgttgttcataaaacccagtgagattgttgcaggaggaggcatccttatttaaataaggaacgctcattgcttgctaaaataaagcaatataggggaaaataattacatttgttcaatttcccaaatgcaaaactatactcaaaaaaaggcttaagctcacacctatttagtattaaaatgtctcctcactcagagagctttcaccaggatctcacaaaaatgacttttatttttggctggcaagcaacctattaattctagactttatatacatgttctaatttccatttcacagatccatttttaaagtgtcaaaactgccatgacatattctcaggggaaattcatcatgttttaagaagtgtcaccactaattcttaccgagtagtactgactttcctttgagagtaaaaatgcatgcttaaagtaccccgacttcctctgcatcacccccacactcttatttatacacaatttgctttcatcagaagcaaccttgtccttttaatcgcctttcttaatacatcattattataagtttattctcgtggacctcctggaacgcatgttcttaattctgacttccaggaagcaaagctattcatatagagatagtgatttgaattttggattcgggatcttgatcaaagtactggtcactttttcttttggtgacctaaagcttatctttcttgaaacatacattatgattgatatcggtagccataaactgtagcttagagagatagaaacactttatatcttataaaactctcattttataaaactcaaagaaaaatgacagcatcagaagattagacttggtcaagttcagcaaatggaactgcctcaatctttcttcccattattagtgtaaaatgtgatttgaatcataatgacttcttagatttgtgtgcttgtcttatctctctagtgactgaggcagaacagtcaatgtatctctgacatgtactagtgtagtcgacagtgttacaaagaaaatgtagtagcaataaattttcccttaaatagctcatcaaatgccagttggcttgactgtaagataatgttagtgtttgacccagaaaatgcaatcaatgtcttgcccaggctataaaaatgatcactggttgacttaatatatggcactaggcacccctgcaggagtaggactgctaccgtagtcattgttactttctttgtctcaaaatttgtgtctctttatttcagcaatctcataatctaaataatgagaaaataccacataaatctccagggagcttggatctaaaagctttatggaagagtagagagaaaaaggttttaaatcttagtatgtcactgaatagctgtatgcaactgggatactttctaagcttttctgtggtgaaaattgtacaatgttgtgaatgtaattaatgaaactgaattgtacacttagaaatgcttaaaatgacaaatgttatgttatacaggtttaacccaaattttataaaatgaaaaaaaatggctatggatattttataagttatcatgagtgaaactaatatgatttgtgcttggtatatattgttttgagtattataaggaaatttttggattgtaatcatctcacagtgtttcaaatatggaattgtgattttgtgaactgtttcttgtagctgccttaacacccctgttccaatccccatacctacagcgtattgcacatcaaaatcaacgtgaatattgttcatttgtaaatatacgaccaaaaatcatgtttcattccaaaatgaaattgagaccttttgtctgatcaagtttttctaaaggtattctcaacagtgttttcatccattgacctaccaaattttgcattcagacttatttattaaataaacaatttgataaatgaaatttaatcttatattaatttttcaactcctgtaaccttaagcaccactattgtaaaataaagatggtgatgactcttctttttaccacctcattatgtcaaagtgtgtattgttgttagtgttatatgtgttataatacaaatgtaacttttttaaaatcagtaatttttctgcaagtaaatgatggggaaaatttggcactgataccaaattctaatgtttagaatgtttaatttagaaaatcatgagctggatttttttgtttgacttgtggaaatgcatattccttctttcaattagtatgtattaaacattgaataatctctgtgggaaattccctttaagactttacacagaaatatctattaaaaatgcaaaaaacagtaagttaatttgagttccattgaaatcagttctttgtttatagccatacatacaagtgtacatattacatacataaaataatacataattttaattttaatagattaagaaaaatgtgtatgttttaacattactaatagaaggtgactttttatgtatatggtgattcatagtttacagtgaacctctatgcaagcaccgatgtaactcccttgtttatattatatttaaatatgaacaccacacattcaagtgcctagaatagtagcatttctataataacttcctttttctttctccagtgcttctactgaaggattattgaatcgccaatgcatttcatgtaatttcatgaaagaacaatgtacatattttgatgccagttttagtcccatgaatcaacatttcttattattctgtgaaggtaagataatacatgaattctgatataatatattttattcattgtatttggtcaatatctgttggtatcagcaactattactctagatgatttcataatcttaatttataaatttttgttaataggatatacattatatatagacttactgagatacaattttttacatattttgtatagaaataaaaaatgagaataagtcaataaacatgcacacataattaataagtgctatttgaacatgagcaactttaaaaggtgaataaatatatttacatcagcgaggccatgccacaatcataaactaatttacctagtcttcagaaaaagtaatagtctagtcttctttttaaaacaatgctttggttgttaagagatttaggatctatggaaatttaggacctgtggaaattgaattcccctgcttcagagttcttcagttctgatcaattacattcaccattattacttcttctatcttgtaacaatatgcgtagtcttacatgtttatacagtatctctacaatatattcatagaaatcattttccttttaatatggtactgtattttccagagattaaatagaactcatgtgtcctcttataatatgaagagttgagtgctactactgcagctgatatattaagctgtccttttttaagagacaatgagagatataccaagacttactttttgacattgtttttctcttgatatatgaaatgaagtaatcaaaaaagaagtccttgtttaatgacaccaggaaaaaaaaattagttttagatgggattccttagagaagtgaagtttcaagataactttttacagtaacaaattagctagtgtattttaaatatttgaagattatggttaacgtatttttaaattaatatatagttaccacccaattttaaacttttcttatggatgaactatttccaatatgcgtgctttctttttttggctgagtggcaaatagaatttgatcttggatcagtggatgaggggtgaaagggttgtgaatcagctttgtgaacatcagtggctagtctataaaagactagagataaagagaaagcatgtagaattggctaaaaacatagaaatatagaacatttgggggaagagagaatcttaacaataatctctgcaaatagtttccttctcatatattcttacccttctgaataaaacgcttataaataggaatgaaagctagttatctggtttctgttttgttatgttttaaccacgaagtgcttccatttggggggaaaaaactattatgtaaactttctaatgattattacttagacatctttaaaaatatttatacacatatttttaaattccaggtccaagggtcccagtggtcagcctacatagtacggacaacccagcaagtgagtacacaagaagacaattaagaatagttatggttggcattagtcttagacatcgtgttatctattctgagtcatatcctctataaattcttcttcaaaaaatccccaccatgaggaaagctgcgtgtataccatcaacttgaccttatgtatgtaagagaaacagtaaagcaagagatatgagccatgttacaggtgggaggtgaatcttatatgcccgaaataggatatctactacctaagtcaaatagagttattgatgaaacaggtacattttagcttactggcctcttaatgttctggttcattcttgcctgggcctcacataagttattcctccagaataaccttttgaagacatttcagaaaattatgaaaaatgtgttattttatatattttctatcctgtttgttccagatatccaggttcttctagttttgtatatgcactttttcatttatgaatttattcatttgtatatttgttaggtttgttaagagatcacctacttttgtcaaacaatgtgacagagtcggagggtacactgaaagagtgttttgttcaagaacttacagtaaagtagataaataaatgcatggttgagcttatcttaaaaatgaataaccagatttcatcctgccttcctttctctttcctttcttccatgtttgtatccttctttcattttttaagttttatttaatcaatgcttctattctgtgatgatttcacataagctactataatctaataatggctcatatttattgactcacttgaactttggaatacctctgagatagttaatttgattatccctttttacaggtgagaaaaattagtctcaaagaggttaagtggtaataacttggccagagtcatactaataaatggcagaaccagggatcaaatgagacagtctgactcgagaataggtttataattcactacaatataataactactttttctattgtgcttttgcctcatgcattgcatactcttatttaagtaggagtcagttaggtggcttgacttagaagatatataggtaaaaaagtgtaaggttgaatgacaaatatcattttgagaaaacagaccaagaccatttatattgttcaaataatgtcatatagacacttagtgcatgcccgaggcaacaagaaatttctaaatttgtgttgggtttttgtgtggctgaaagatggtttagcacacattttagtttctatttatttcattatttccgtcttcagtgtaaaccttaaaaagattatgttaagcaaatcaaatatattcaatattaactctaacggcaacaataatgaccatagacagtacggttgataaaatggaaagaaggttgaatctcatagatagaactatcagtgtataaaataagtctatcacatgctttttgtgggatccaagacagtgcgttaacatctcaaaacatcagtgtcctccgagacaaataaacaaatgtgtttgcagtgaagatgagtaacattcatgacatataggacacacttaatcaataactatttgtgttacactgtatatcttgcctttaacaaaggatgattaaaaattttccaatctgattttaatttaattttatcctgttgttacaaggcaatgtcttttctaataacttctgctgcaaattacaaaacatttctgtctaagggaaatcatgttattttcctgttcaaaagccaatcatgtttgtctcaaggtcaacaaaaacaaaaaaaggctgtgaatagtggtcaagtgcttaattttcttttcaaaagataattacttagggagataaaatttatagtcaatggcaagtaaatctttgggtcaatgaaagcaaatataccaatgagtaagtcataactcatttttgggccacatgaagtagaatagtgcatggagagaaaattttaaaaaagaaaaaggaaaatatttaacaagcatggaaaacctttaaacccactagttatcaaagaaacgcagaagaaactactgccatgtaatttttcctaacaaattaataacattaaaaatttacattactaataaagatagaatgtggtagaaatgttaattataacatattaaaaataatagtcaaaacttatttcttttgtttttttgagacagaatttcactcttgttgcccaggctggaatgcaatggtgtgatctcagctcaccgcaacctccacctcccaggttcaagcaattctcctgcctcagccccccgagtagctgggattacaggcatgcatcaccacgcccagctaattttgtatttttagtagagacggggtttctccagttggtcaggctggtctcgaactcacaacctcaggtgatctgccagccacagcctcccaaagtgctgagattacagccatgagccaccatgcctagcagaaacttaattcttttatatcattttttcatttttgtagtttacactgagaaaataattctaaatggagaatattatgacaaagctattgaaaatagaaaaagacattataaataacaaataatgggagtttgtaagtacattttaatggaatattactcagtgccctgggcatcttccatctgtttttccagaaccacttttaactctcaattcttctcttcgatgttctctggcctagaagtactttctatagatgacttaggttctgttgccccatggcttccaactggattcaaccaaaggaaatcttgtaggcaactggaaagagggagaaaactgctctgggttgtttattccaccagccgtgttcctatggagtcaccacaggttggctgtgacctttggctgaagggaatcttcacccttgaccttcaggcccagccactgttttcttgaagttttctcttttcactgtgtttctgccaggttttggtatcagaatcatgctgacctcatagaatgagttgggtaggaatcccttccccttgattttttggattagcttcagtaggattagtagcagctcttctttatacatttcatagaatttgaatatggatccatctggttccagcctttttctagttggtaggctttttattactcatttaatttcataaatcattatcggtctgttcagggtttcaatttctccctggtccactcttgaaagggtgtgtatgtccaggaatttatcaacttcttgtacgttttttagtttgtgggcatagcggcactcataatagtctctgaaggctttttgtatttccatggggtcagtggtaatgtcccctttgtcatttctgattgtgtttatttgacttttctctcttttttcttaggctatgtagcagtctattaattgtatttatactttcgaagaaccaacttttggtttttatgctttttcacgtattcatttcattcagttcagctctgatgtgggttttttttttttcttcctcctgtagctttgggattgatttgctcttgtttttctagtttctctgagtgaatattcaccattttttaagcatttaaaattaaatgcttaggatagcttctttggaaatacactaatgtttaaataatcagagtttctttccattttaaacatgtaaaaaacctcttagaacatctagtcttccagatatatataataggggaagatatttacttacaaaagaggtagtttgatgtgcctgaggttacacatagacagcgtagtccaatgggagaaacataaaattacatgcttataacagtctatgattatttctctagtaaaagtgcacacagttcaggacaagaggaagtcaatgagaagacattttcagaaaaacgaatgtgtgtatacaaacataagaacgcataaaagtgttcacatttgcaagataaacattgttcatcatagctggaacaaaacatttactaaaagagcaaaactatatgaggccagaggggcagactggaattggattataactcttatgttttctaagtagtttggattcaatcatatttgttcaatgataaacctttgacattttattttattttttttctggccatggagtaactggaaatagacctgattcccttgtttcctttaataataataaaaaaaaagagtaaagaaaactggacaaaatatacaaatcaactgtttccagacattcaacaatagccagcatgggtctctgatccctgaaagaaggaaacaagtacaattagtgttgtaagttctctggctttcttgttaatagaaatttctgaactccaatgcaataaggaataagctaatcataatacaatgatatctctgagttgaggagacagaaaatgatattcagaaagattgaggcttatggaatgttgaggaatggtatggaattttatggaattgaggcttatggaaagatgaaactggaaatgaagaagccacatggagaaagacatctgcatagggctggaagagggatcaccctgaatcagctgctgaaaatacctagctgagtatgcataggaagatgcttcatgagtgtgggcaatgccggagctcacagagtggtgggatttgctcaagttataatcagcacagtagtggaacatttagaagagatcccagaagtgtcctgccttttgtagtgctaaactagccatagagcaaaggtcattcaaatacacactaaaaagatttcttgaaaagtcttgaaatggtcaacctgcctgcaacatatgccagaacaaagtccaacaattgttagaagatcacaacaaaacccaggctttcaaaatgtaaatgtcacaatggttggtatctaataaaaaattactagctttgtgaagaaagtagaaaatattactcataaataggagaaagattagtgaatagaaacaaactcagaaatgacagagatgatggaaatcactggcaaatacagtaaattagctgttacaaatacataaagccatcaaggaaagaatgaatgtagagagaaaacaaagataatatatttttatgaaagaactttgtgaatttaaaataaaatatttgaaatataaacttcactggaaaatactaagaacagattagatgctgcagaagaaaagatcagtggacttgaaacaatatcagtggaaaatttcttgacacaaatagaaaaggaatgaagaaagtagaacctaaattaaccataggccagtatctacatctatcatatttgtaattagagtcagaatggggcaaggaaacttgcaaaaaatatttgatgcaataacggccaaaaattttctaaatctgatgaaaaagttaaaaaaagttcaacataacggaagcaggataaatgtcaataaaaccacactagcgcacatcattagcaaattatgcaaaaccaatgataaagaaaaacattttaaataatcagaaattaaaagacacattacatccacatattatgcacatagtaaaaacgaatgactacagacatctcatcagaaaaaagcaaactggaagacaatagaacaaaatgctgcaaatgctgacggaaaaccaaactgaactaaacaaaaattcttaatagaaaaacaaacctagaagatatttctcacttaaaaatgaagacaaaaagaaagtttcaataataaaagaagtgagaacgttctgtcatcaaacttgctcttctaaataacaaattgatcaataaaaactaaataattagaaaatattttgagctgaaggaagatgaaaacacatcagattccaatttacgtgtaactacagctgtgattagaaagaaatttatgactctaacttattatataaaaataaaaacacaacagatcccaatttaggggttactacagttgtgattagaaagaaatttatgattctaacttattgtataaaaagaaaaggtttaaaatcgataatctcctctttcaccttaaggaattagaaaaagaagagcaaattaaaacaaagttgaaagaaggagattgaaaaatgactaagaaggaaatgatattgaacatagactagcagtagagaaaatgtatgaaaccaaaagttgcttccctgacaagatcaataaagttggcaaaattctagtgagagacatgaagaaaaagagaaaaatgtaatgccattaataaaagagatgatgtttatacaaatgctatagatattagaatgacaatagtggaacattatacgtaattttttgccagtatattaggcatcttagatgaaatggaaaaattccttaaaatacacaaatcactaaacattcacacgagaagaaatacagtatataaatatgcaattaacattctcctcacaaaggaaactccagatgcagctagtttcactggtgcattttatgcaacttttaataagttaataccaagtttacacaaactctttttaaaaatataaggcaggccaggcgcggtggctcacgcctgtaatcccagcactttgggaggccgaggcgggtggagatcgtgaggtcaggagatcgagaccatcctggctaacacggtgaaaccctgtctctactaaaaatacaaaaaattagccgggtgtggtggcgggcgcctgtagtcccagctattcaggaggctgaggcaggagaatggcatgaacctgggaggcggagcttgcagtgagccgagatcacaccactgcactcgagcctgggcaaaagaatgagactccgtctcaaaaaaaaataaaaaataaaaaataaggcgagtattgaccagattccaaatccagacatatatattaagaggacaaaaaaaagatcaaattttctcatgaatttaggtgcaaaacaccttaactaaataatagcaagtcaaacctagcaattatagaaagtatgatagtttgttatggccatattgggtttacccaaagattctgtgtttgctataaccttcaacaaacaatgtaattcaccgtattacactgacacctcaaaggagtttttaaaaacttgaaaattttggcaaacaataataataataaattaataggaatacctaatcaagataagatagaaaagaaattcctgaacttcatgaatgatatctgtaaaaatactacagctgacatcatgcttaatggtgaaagaatgatgctcctgcctgaggactgggaaagtcaagaatatttgttctcactccttctgtgcaacattgtggtagaggacttagccagtaaagtgggtaagacaaagaaatatatgcagtaaaactgtgtttatctgcagaagacatactgtgtacaaaacaaaaaggaaggaaacaaaaaattgtggaatatacacacaataaactattgaaaataagtgaatttatcatggttacatctgtaggccaatacacaaaattcaaccatttcatcaatgaaaatgcaagatttaggagtatttttaaaatgctgtttaaagtaacatcaaaaatccatggagtatctaggaataaatccgataaaaatgaatacctcctctaaaatctgtataatactgctgggagaaattaaagactcagatttctacagacatagacttgtatatatctgtatacaatatgtacacatggatatatgtgtgtacaatatgtatatatgcaaacatatatgtgaatgtatatatatggattagaaggctatttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggctatttttgtgatgtaaagtctctccaaatagatctataaatttaatacagtgcacgtacctcaaaattccagcaagttactgatgtccacttcatgttttatcaaattttttgatgtttcatttttgctatttctctattactgtattttcaaggtcattactcttttgttcttcagtgcctaatattttattaatatcacccagtatatttttcatcttagatcatataattttcatgtatttcagattctgcagtttttatttttagaaatatataacatgctcatgctttttctaccttattaaatacctgaactacaatccaggtgtcctcatcctgtgtttctgtatcccttttaattggtataggtacctaggtattgtgaatcgcatctcatttggtgctagataatcttgtattttgctaaaatattcttaagcaggttaacaatatgatcagatttgcattttgaaaacgtaaatgataaatttaatatagaagcaaatgaaaaagttttactggcctaatgaagcttacttagaaaactgttgtagtaattcaaaagagaaatgatgagttaatcagcacagtgcctgccaaatggtaacaagtggataattttttgttgtgtcacactgattctgtttaatgcataggggttagctatttacactaccctttttggtttacagaatattttatattggaaagcaattctatgctgaaggaagctatcctgaagaagaagataggaaagccagaaattaaaatccttcatattgacgactatggtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaaatcatgtataaagatgtgtaaatttttttgaacttcttgcatcccacatggagtttggtgctactgccaggaatagtgacactaaatagtttgatttgtgggtgtctgcttagcaattactcaagccctgcgctctttatcagttgtttatgcaacattgtggaacatgtaattccactgctaaaacaatgggttatgtttgtatcactcctattgatttttcctcctgcatgcatggcctgcagtaagctgctcctatgctcagaaaacttgactcaagtttttttcatcttgaaattgactttgaagttaaatatctttatacattttgtaaggctatatcatgactatatagtattaggcaccgaggcccctaacatctaatgcgtaactaacttgatattgatttagcattgtattcctgagagttataagttatttcccttattaatatgatcaggtagcatattgatataatagtgcttaaaacagtctaaaattatatctttagatacaataatttcttcagatataatatttagaaatagtaaatatgaaaataacattgcttattatgatcactgagtatagtggataagtattcagtctgtggaatcggatttcctgggttcatattctagttttgctatttattagctgtgtgtccttgggcaagttccttaacctcctacaaggctaagtttctctaaatataaaacaatcattacaatacaacctgtgttttaagactgctttgtagactgagtgaaatacaacatataaagtcccttaaacagtgcctaacacatatgattcttataattattgcgattataattcttttttgtatagactgcatttattttatttagatattttaatatatacaagcaatttgtccctttattttaacaaaccacataatacagaaataatataatatttaattttctctctcactctagtgttcatttctaattctaattattgagctttatatagtttctcatatccaaacttttctcccttgtccctaaaagccagaaagctctgaaagttcttaatgtctccttgaggaagttcttatttgctgtttcttaattcattgtttttttttcttgtcttttttacctagtttcttctggtctattttaactgtatgtatgatttactgaggaaaaatgtttaaggcactaaaacgagacaaaaagaaagcaaaaatcaaacccatcttctatctcagtcacgtctccctttggtaaaaggaaatgttcttttgattcactgaaaaataaactttctcaaggaagggacatccctcaggcacatcctaggcatccctcagtatgtgatgaccttcaaaatggaagataaaagaactgactgcccttgaagcatgatatttatgcagacgaatgtgtagataattatgcccacttgcgtatccacctgctgtagggcagtgtcacacatagggggaaaaccgaataagagttaacagaatctctttgttttctgaaacagataagctaactggctcatcttggcatcagacttgtgttttgttctggttgatttttagtttataagaggaatataaggacctacacaagaaaccaatttgaagacttctcttattggcaaggggcacttggggttttttttgagaagtgggattttggagcaaaatgctggttttggagtcaggtaggactgggttcaagttggagtgctgagatttaacaatacactgctgaattttttgaatcttctgttgccttataaataaattggggaaaataacatgggataatatttctatttaaatatattaccatagtttttggtagagcataagcacttgcagatagtctttaataaatcataagcagaattataattattattagtatggtgcaaaagtaattgcagtcattataaatggcaaaattataagtaattgcattacttataaatgcaaaaactgcaattgcttttctgccaacctaatatggataatagtattttaaagtatttaatgtgattaatataaatatttaatgtgtaatttaatgcccataaagttattcaatagacagacactactaaaatagataaaatagtgccgtcagacccatggaatttactttgctacttttttggttgatacaggaagaatgaatgaaaatgagtataaaatcatttctagttatactttgttatatatagttatatattgtttatactaaatattaattgacattatccacacttttgggttttagagggaaattatcgaaagcgtcacagaatgtgacttacaaaatccaaaaggagaatttctttttttttaaatttatacttacaatatgatctattcttttaaattgcatgattatttctaaaacactatgcttgaaaacatataagggtcagaatagcaaaagtagaaagtgttttttaagaattttaaaaactgcccatgatttaaagccatattttttctcaagcttaaaaactgttttcagtgacaaattgacttcccattctaaaagtaataataattattatttttttcgcaaatgagcaattagacagtgataaacaatagagcgactattatttaaatgagtctaagaggtcattcagtgattttggtgtcagtactttattgcaattttgtgccatatatctggtagccaacagaatatgagccatttcttgatctgtagtgatgggtttacatccaaggaattatataatgaatgcatgagttagcgtcaggctgcagcaagcacctgagtggctgaaagaaagactgccctggaagaaagtggcctctggcaatttggaaacccagttctgctcaatcttcattatggatcttcaaaagaaatggtcctctgacctcccttgcttggtcatatgttttgaaactcaaacttaatctcgtaacatttaaaatgtaagtgaatcaaagatcaatgtcaatgtcacattaaaaagagtatgcgggatggagtacataccacattaatatttttactgtagaatatttttaccataatggaaaaatctaagaagcattggcaccatagatggatctcagtgacctgagtttgctgtggtctctacggagtcatgatcccctttttctgaacaactcctccaattctcccttcaagtgcctatttgttttactcctgcctttctgtttaacattatagggagcccttaaggacccggagtccttattcatttttaaacttattctatacacatctgtattcattccagctcttataacctcgtattgttcttttttaatattattcttacttcctactcatgtttatgtaatttaataccatacacgtctaccacattgcttttacatatgagaagccgtgttaatggctatggggagataacaagattgcaagcatcttgaagtctataatagttatttgggtttgttcagtctatctccgcaatgcctaatacacagaacttactgactatcctgtaattaccaaatagtgccaagactgaaggtgttgtggaaaatgccctgcacttgcagacgttcatttggtaaacaaacaaatatgaatctaatatacttagatgctgataaaagcaatccagaaggttgtactgttatttaaaaagaagggatttttgtttttgtttttattttctgtccctctgaagaggagcagcatcagctcaggagtttatttcagtaccaagggcccgtcatctcttcccattttctactttttcatgctcaagttatcttgccacactcgttaaaggtctaataagggaggcagtaaatgttcaacagattatattaacttccagaatgcaacatatgctatcttgcctccatgactttctttcctttctctgaattcaccttccttgaaatcccaagaaattcatggtcatccatcaagtcttatcttcctggagctttcttccattctcctcctctgtcagcctatggatcaggtcattctaaccggagagcattattcatttttatctagagtctcatcactgaatgttctgtgtatcagaatcctataattgggtcatcttggtagaagtgatctgttttctatataagtattctttcaaacagcatgatataagtaactgatcattcacaatgagggaatatattcagttattcatatccaacagtcaagataacatcattgctggtttgttatacacacatttcatttcctcaaacaacttgaaatattgtttaatattttaattagcatcaagcttcagacaagtcagacatcctatctggatgactgaactctaacctgctatactattctctacttacacttcctttctttagtttattgctttttgctctctctctcttttagttgcttttccactctgctgctaggttgaacttggcaaaatccatatctgagaatgtagccctcctatctaaaatcttctcattattcattcatcattgattaaagctctgcgttttccctcacactacgtaacagtcttcatgatatattttctatttttctcttcgtttttatctcacatcagccacccccaaagagaaatcccatcctttagacagactgctttgttctggggaacaccaccacttcaatcatcacttgtgttttcacatagcctcccagtgccctgagtttgcctgcccacctggagaagttctcttaagacttccagacacacttccagataactttatgcacaccgctattacaaacatgtaaccataccagattacaacatttactttgctttctctcctgttaaactgccaattccttttgaatagttttgccataccgcactaactggagcattatttgatagaataaatgaatgaatatatgaatacatcaatgaataagtaaacaaatcaattaaccctgagtttgtcctcaagaatgaattaagtcgagatggagaaatggagaaataaatgatttgtgagtttataattgatttctgtatgggtccatttctctgcaatttagttttgtactcagaatgagacgcgagtttctaatttctcttatagtctttctggatagggctgaatattgattgattttcatgctgtctcttcactgtttctttttacaatttttttacttagcttaagataataagaattgatattagctaccatttattgttattgtgcaaagagtgtcttgctgagaatatttagacatcatctttagtccttatagaaatcatccaaggtgaatactactgtcctcatgttaacacaaggaaactataactaaaataggtcatgtatgtgttcccccaagttcacagaaggaaaagttaaggtttggactcaagttttatatatctattttctgtattaaaacctctgctgtattacccaatgctgcctgcctacatagtccaccgtattatgataattattggcatattatcaaagaatgatgacttgaatcagaagaggcttctctactgccaaattcttatgaacttttcttctttccactgaacagtttataatagtttctggaatataacattttccacatgtactatgttaatgctttggtgtaaagtattgattatacaaatcatgactgagttcatgaatattccacaagagagatcaaattctcagctcagattatttaataaaattctgaattctcatcaaaatgttcactttgtgggaagtcttttctactctgtatttgtttcatagattcctagggttttcgcagatcagattgtgagaggtgagttcattttgtttcccaaggatgaagacatatatattccaataacttccaacatcatttgatcttctatttgttcatgccaaatacacatctacttttaccctcagtttcttgcaaaaatagtacatataccgtctgatgtgggtgaaagagatagcttgttgatattaatgtttgtctcaaagagggattattattgctttgccatataatgaggttcaaagcttaaattttaggtttatcatttttgtatctttgtcatttacatggatggagaatgtacccacactgtaatacatagaaaatgactaagaagaaaaaaggcagtggcatttaatcttgttaatagaaggggagaaggtgatcatttgtttctgtttttttcttgaacatatttaaacttgttctttcacaatttgtagataatgcatcttaaatgtcagcattaacttcttaccactatttaaagttgtacaaactcaaacttgctgtattaagaaggtgacatgggggaaaaacccaaatttagataaatttatagataatgcctaagctataatatttgtttggtgtttattttaactggaatatatatatatgtgtatatatgtgtgtgtgtgtatatatatatatacacacgtatatgcacacacagaaacacacatgccattttaggtcttctgttaacataggttttagatatgcatggattcacagaattatatgaatgatataatatggtttcatatgaatgatatgggcttattaatagttcctatttaaaacttacatgtatatgacatatttacagatacactactgaatactttttataagaaatattgaacttcgtaatttacaaagttcttagttttagatggtcatataaatgtagtcattaatgtaagggtaattcatattgaaatcagtctctttttctgttttaattagttatttgtttttaagaaaaaacatattaggatataagattaactatattattagtttaacatgactttgaaaggtgaagttaaaaataccaagatacagtgtattctttcttggtaatcccacacatctccacatcagaggaatacatcaatgacattatgttattccaggattttttaaataatatattctttccttttgacttatatataaaaacagtacattatgaatcatgtaaggctgtgtagcatgtaagtcaaagtgtgtctatgatgatgggaggctaggccagagctccaggcttttctagtccaacatacatatatttttgagcaacaagtaatgtgcaaagttccctactaaaaattacagggcttctaggagatataaaacttgggaagaaactaataattattgtatttttaaaagaaaaccacaacccaaataatacaattgttattaatatagtaaagttttaatcaacgttttgatttggaatcattcagtcattttcagcattggactttagcacttgttcttcctcttggagggcattctcttatagccgttttttctcatttttagcatgccattttaatcaaaattataaacctgatctagctgtagccttcttcattaatccactatctgagtccatgtctttgtagcctgtatgattagagctctcagttgtcacctgtccctcagtaacatggaggaagcataatcaattggaagttgctagatcagccacaactcaccctaaaaaagtgcttccgttgatttttagcttttttattaaggttccaatatattgctaagactttttccttacttataagaaaatgtggctctgatttcctctagacattaataccttgggaaaggctgtgtctgcgccactatgacagtgcattatactgacataatctccctgtttttcatcacatagaaaacatgtcatacaagataaatctatgttgcacaaaacatgctgcatctttgggaattaaaagtgttgaaaattatattgatacatatatgttaatgtataggttatatatattttaatttataagggcacacaaaaaaagtccatctatataacatgtagtttacacacttcctatgcttttattttttctttttttattaatattattatactttaagttttagggtgcatgtgcacaacatgcaggtttcttacatatgtatacatgtgccatgttggtgtgctgcacccattaacacgtcatttagcattaggtatatctcctaatgctatccctcccccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcaccattttttatggctgcatagtattccatggtgtatatgtgccacattttcttaatccagtctatcgttgttggacatttaggttggttccaagtcattgctattgtgaatagtgccgctatgaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattataactggtgtgagatggtatctcattgtggttttgatttgcattgctctgatggccagtgatgatgagcattttttcatgtgtcttttggctgcataaatgtctttttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgacagtagtttcttttgctgtgcagaaactctttagtttaattagatcacatttgtcaattttggcttttgttgccattgcttttggtattttagacatgaagtccttgcccatgcctttgtcctgaatggtgttgcctaggttttcttctagggtttttatggttttaggtctaacgtttaagtctttaatccatcttgaattaatttttgtataaggtgtaagggagggatccagtttcagctttctacatatggctagccagttttcccagcatcatttgttaaatagggaatcctttccccattgcttgtttttgtcaggtttgtcaaagatcagatagttgtagatatacggcattatttctgaggctctgttctgttccattggtctatatctctgttttggtacgagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataggaaggcttgtgatttttgtacattgattttgtatgctgagactttgctgaagttgcttatcagcttaaggagattttggcctgagacgatggggttttctaaatatataatcatgtcatctgcaaacagggacaatttgacttcctcttttcctaattgaataccctttattcctttgtcgtgcctgattgccctggccagaacttccaacactatgttgaatgggagtggtgagagaacatacctgtcttgtgccagttttcaaagggaatacttccagtttttgcccattcagaatgatattggctgtgggtttgtcataaatagctcttattatttgagatacgtctcatctatacctagtttattaagagtttttagcatgaagcgctagtgaattttgtcaaaggccttctctgcatctattgagataataatgtgatttttatctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcttcaaggatattggtctaaaattctctttttttgtagtgtctctgctcggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgctccaatttcggagcctgttattggtctattcagagattcaacttcttcctggtttagtcttgggatagtgtatgtgtcgaggaatttatccatttcttctagattttctattttatttgcatagaggtgtttatagtattctctgacggtagtttgtatttctgtgggatcagtggtgatatcccctttgtcattttttattgtgtctatttgattcttctctcttttcttcattagtcttcctagcggtctatcaattttgttgatcttttcaaaaaaccagcttctggattcattaattttttgaagggttttttgtgtctctatttctttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctacacactgctttgaatgtgtcccagagattctggtatattgtgtctttgttctcattggtttcaaggaacatctttatttctgccttcatttcgttatgtacccagtagtcattcaggagcaggttgtttagtttccatgtagttgagcggttttgagtgagtttcttaatcctgagttctagtttgattgcactgtggtctgagagatagtttgttataatttctgttctgttacatttgctgaagagtgctttacttccaactatgtggtcaattttggaataggtgtggtgtggtgctgaaaagaatgtatattctgttgatttggggtggagagttctgtagatgtctattaggtctgcttggtgcagagctgagttcaatttctggatatccttgttaactttctgtctcattgatctgtctaatgttgatagtgggctgttaaagtgtcccattattattgtgtgggattctaagtctctttgtaggtcactaaggacttgctttatgaatctgggtgctcctgtattgggtgtatatatatttaggatagttagttcttcttgttgaattgatccctttactattatgtaatttccttctttgtctctgttgatctttgttggtttaaagtctgtttcatctgagactaggattgcaacccctgtctttttttgttttccattttcttggtagatcttcctccatccctttattttgagcctatgtgtgtctctgcacgtgagatgggttttctgaatacagcacactgatggttcttgactctttatccaatttgacagtctgtgccttttaattggagcatttagcccattgacatttaaggttagtattgttatgtgtgaatttgatcctgtcattatgatgttagctggttattttgctcattagttgatgcagtttcttcctagtcttcatggtctttacaatttggcatgtttttgcagtggctggtaccggttgttcctttccatgtttagtgcttccttcaggagctcttttagggcaggcctggtggtgacaaaatctctcagcatttgcttgtctgtaaagtgtttttttctccttcacgtatgaagctcagtttggctggatatgaaattctgggttgaaaatgcttttctttaagaatgttaaatattggcccccactatcttctggcttctagagtttctgccgagagatccgctgttagtctgacaggcttccctttgtgggtaacccgacctttctctctggctgcccttaacattttttccttcatttcaactttggtgaatctgacaattatgtgtcttggagttgctcttctcgagcagtatctttgtggcattctctgtatttcctgaatctgaatattggccttccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttcatgcttcatttcattcatttcgtcttctatcgctgataccctttcttccagttgatcgcatcggttactgaggcttgtgcattcgtcacgtagttctcgtgccttggttttcagctccaacaggtcctttaaggacttctctgcactggttattctagttatcctttcatctaatattttttcaaagtttttaacttctttgccacgggttcgaacttcctcctttagctcggagtagtttgatcttctgaacccttcctctctcaacttgtcaaagtcattctccatgcagcttcgttccgttgctggtgaggaactgcgttcctttggaggaggagaggcgctctggtttttagagtttctggtttttctgctctgttttttccccatctttgtggttttatctacctttgttccttgatgatggtgatgtacagatgggtttttggtgtggatgtcctttctgtttgttagttttccttctaacagtcaggaccctcagctgcaggtctgtcggagtttactggaggtccactccagaccctgtttgcctgggtatcagcagtggtggctgcagaacagtggatactggtgaaccgcaaatgctgctgcctgattgttcctctggaagttttgtctcacaggagtacccggctatgtgaggtgtcagtctgccccttctggggagtgcctcccagttaggctactcgggggtcagggacccacttgaggaggcagtctgcctgttctcagatctcaagctgcatgctgggaaaactactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttggagcttctgggctgctttgtttatctactcaagcctcagcaatggcaggcgcccctcccccagcctcactgccaccttgcagtttgatctcagactgctgtgctagcaatcagcgaggctcggtgggcttaggaccctcccagccaggtgtggggtataatctcctggtgcaccgtttgtgaagcctgttggaaaagcaaagtattagggtgggagtgacccgattttccaggtgccatctgtcacccctttctttgactaggaaagggaattccctgaccccttgcgcttcccgggtgaggcgatgcctcgccctgctttggctcacacagggtgcgctgtacccactgtcctgcacccactgtctggcactccccagtgagatgaacccagtacctcagctggaaatgcagaaatcacccgtcttctgcgtggctcaggcagggagctgtagactggagctgttcctattcggccatcttggctcccattttttttttttttttgagacgcagtctcactcctgtcgcccaggctggagtgcagtggtgcaatcttggctcactgcaacctctgcctcctgggttcaagctattctcctgcttcagcctcccgagtagctaggattacaggtgcccgtcaccacacctggctaatttttgtacttttagtggagatgggcttttgccacgttggcctgactggtctcaaactcctgacctcaggtggtccgcctgcattggcctcccaaagtgctgggattacaggtgtgagccgccgcgcccggcacttcctgtgctttcataagaacttgtactctcaccgcattatgattacaacagggcagatattctaatccccgtttttgcaggtgagaacccttgagggacagaactgatgagcaatatgcctcatgttggacaactactaagaagtgaaaactcagcaacaatgtgccatacaagcttttattacttttccctaagaaaaaattctagggataaaggaatttaaaatacgtggtgtaaattcagaaaaagacccataattagagcttaataaataaaagagattttttaacaccttaaatttataatcttattctggctaagaattccaatttccttttgccttgaggatataattgcttatatgccaaaggtataagtgaatattttgttgaggtcaacttttataattgtgttctctcaaaaaactggtgttatttgtctatctatggtttataatttctttaccgctatatgtcggtttactaagttgcaagatggttctgccactgcctgcttatacttagtactataatcattattattcctatttaactgatgcaaaaactcagctaaggtgtaaaattccctatgtttatataaccacactttccagttgataaatggatttttagaatgcaggtaaaggattatatagttagaaaaccagtattgtatcaccaccatacattactgaaggtgtcatgatgccctaccaaggatgaaatacaggttgaaagttagtaataattagcatccattcctgtattatcaacccattgcacacatatgtatccttcgatatgtagcctatatgtattgtcagcctcagtacgtactcactacattcccatgctgaattgccctctccttgaaaaaatacagaaatttaagtttgttgtggagattgtcacctgcttcttttttaaagatacacacactttgttctattttttatctaaattgcccccccacccccagttcctgaagcaagcatgtagaatattttccatgatcatatccaaagtggacctgctgcataggagagtcacattgcagttatgtgcacgtgaaaactgagataaattctcctgtctttggtgtgtttataaaatgtgctaagctttcttttaaccatgaataatttaggtatgaccctttctaagtgcaagagaatagatcaaatgctatcctagctctgtgatgatatagctattcccagcaactgaaagaaaagatcatcaaagcctcttacctttctacttactcactcacactgttagaaattatctcaaatgaaaattggccaaaggataagaattaatgtactaagactttgacagcaaatatcattaggagattgtacattccttctattttattgaacaatttctggctaggagatgtccctgaggtccttttctattggttgtattcttatattttcatgtgctgtccaagatgtttatcctgaggttaattttgtgtggataatgctaacagtccatttctgagttttagagctggctcattaatatctatgctgttcagtgtttcaacttgtgtaacaataaggctttcagtttttggatttgtactacagtacgcgtaactgcagttaaacaactggactctgttttttcttcattactctcatgatggtcattatgcagtttttgcatcaggctaaggagacaatctctggctttcattcaagataaagagcaaaatagtatcaaattcccttcaagacaaggaagagtgcctttggccgataatagttcatcatgacataaggaaaactatttcattaaaaatagaagagagaaaaaagggacaagtaggaggaaggctaggggagagatccaaaaaaagattcaattttattaatgcaaaatacccaaacttggagatcaagaaaaaaaaaaacattaaaacatcaaatatatgtttgggttttttttaattctttaaaaacacgaaaaattctgattgaggaaaaacattaaatgcatttttcaggtttatctgaagtcacagataacaatgttaatgaacagacccacatatgaataagtgaaaagacttaagaatgttttctttaaaatcaaactataactgagttcagaggcactctggattttagcaatttaaaagcaatcactgctactaatctaactatgaagaagctcgtaagatacctttaacatatggataataaaattgcaaaagtgccagacacgtgttcgagagatacacgctgagcagcatatacgtgtgcgaaaggcacaatatttcttttccatttgtatggccgtgtaactataattcaagccagcgaagatttatttatgtgacataaagactactagaataataaagagatttttaaattatgtgtatttgtgcaaatagactagaggtcaagaatacttcgatgacataaaaccaccttccctgagaaacgatgttcttgaatgagagtgcaggaattattgatgcagagttgcatagagatagtcagatttgggtggctcagcttctacaagaggaatggaaggtgtaaggtcaagtcccaaagtgttgtccagaactaggttaataatattgaacacctataccaaggaccaggcactttacgcagctacatatagaatctcatttaatccctgccataactctactgggtagatgctattatcaccctctataccaaattaaaagcaaacgtaggcataagtgtctaaagccactggacctgggctcaactcagtttgatttgatccccatatcacctgtaccttttcacagtgacatgcttacttctttataaagtctaggtcatgaatgcaggcaacctttctgaaggtttgacaatggacaaagtctgagaataaaaatagatgagtacaagtgatttggaggttagtacaatttgagaatttaatttatgaacagaattttttatacattatcaggtagccttcatcataatcaccgccagaaagaaaaatcttagaactaggagatagggtcttggtagcggcatgaacaaccttgatcgaatcaactgctttcctggttatgacttataaaaaaaggaattcaaccaaaagctacactgtaaataaactagggtgaggaatttgaagattatcttaacaatatccctaatggaagaagatgggaatgtggacaagaaacagttctctggtaggaaaaaaataatgtaattccttacatgatgaagtaaatacagtgtatgagaaaattcattcagccattcttcatgtaggaaaatccatctatgagaagaaatttaaaaataataaagagataaatagaaggaattggcccaagaggcccttagccaatatgtggatctatgtgtacatactgcttgaaagagggcaaacttcattatactttagatacacatatgctgcaactaaatcatcatggattataaatctctataaagtaaatttttaattaaaccaaggcaaatattgtttaaagctgctatcctatgttaatctcatattctacctgaaatgaattgtcatgaagaataaaatggaagcatagatagttgattatgcttcagaatataaggtaatattgttctttgcatattgtttccttttccttaccttgatttttattctgttctttactcctcctttcacattctttttaaattcataatacctacaattaaattgcaacccttggttctcaaggattctagctttcaaacaggtactcgtgcaactgagcgaacctgttgtaggcctagaaagagcaatgaactgagatgactataaagcagttctctctatgtcccctctttccactgccccagtggacacaggtaagcagctgacaaattctgccatgctttcaactggtcgtcagaagtcctctcgttagaataatattcttccttccatttattataactaaagctttactgataaggataagagctttcaaaaatgtacttttaatggggtgcggtggctcacgcctgtaatcccagcactttgggaggccgaggcaggcggatcacgaggtcaggagatcgagaccatcctggctaacatggtgaaacctcatctctactaaaaatacaaaaaattagccaggcatggtggcgggagcctgtagtcccagctacttgggaggctgaggcaggagaattgctgaacccgggaggcggatctggcagtgagccgagatcgcaccactgcactccagcctgggcgacagagcgagactccatctcgaaaaaaaaaaaaaagtactgccctgataatttgtgatcttaactatttaccaccaaatattacttaacaatgaaaacaataaataaaaataaaaaaaccaattaattcctcaaggtacctcagcagattggtaatgaaatcaaggactaaaaccttagtcttctgtatataaattcaaccctctttttagaatttaattgaaacactttgtgaacccgatcaaacatgtagtttgaacaaatctctatactttaatccagttttggtataaatgatgttttttatgtcataaagaggtgacttgttctgtcatttaaaaaatctattgagtattgtttgttttattccattttttctatattttattatattgtgaactcatccatacagacacattcagtgttgaaggtattgaaagagatgaggattctgccctcaaagaccttaacttctaagaaaagtttgcagtcttaatttgattctgctacttgtgttaggaaatagacaagtgtcatattgctatgaccttttcactgcttaaaacagatggaattgttcttttcaccgcaactttcaacaaagttgtatgtccccactctcaaccttgaaacacccttcttactgtgaatccccaaagatttctgagacagagataaaaaagcaaaattgtgtagaaggcaaatgagggagacactcagaaagaaacaaaaataactaaatcaattggagctcagcaatcttgcacagccaatacacacatgagtcgtggtacccatttattataagatagatgatttgtctttagtacattctgtgtggttatccctagcaccaaatgttttgctattcctattttactgaataagcactctttgcttagctttatttataagtctagtattttctgctcaacactttgtgaacaagtaatgtccctcattttcctgcacatgcctgatttgttccttataatgccaatgattagcatcataatccatgttcttttaagtgtatgttgaaatagatatgcctatattgtgcaccaaagaaaaagaaacaacacccaattagatcacagaaatgggttcaaaaatctttggttcataatgaattgataccacttcgtgatctaacatttaaaccttggaaagactaggttaaagtttaaaatggcaattaagagaagagagcaaaagagtgaaattgtagttttcttctatgagtgtagcaataatgagtaaaggattgaaggatttgttttaaaaaacctgttgccatttactaattgtgagtttgaaaactgtgccttattttaaactctatcttaaaataatttacttgcctgccataaaatgtctgacttatttacattttaactaaacatatcttagctgggaacttctgaaatcgctgtgaacaaggcaatgtgtcatacgtagattggaaagttatatcttttaaataaacaaaacatcttatgttgccttagcactgctgccagagtttataaaggtgaacaatcctgccttaaaagttaaggacactctggtgatcactccaagggtctgttgattgcactttttttatatccttgtaaggctttagatttcattggtccatctagaaaatgggattacctctgacataagagctcatattacatagcaattatgctttatccatagatattgtgcatttaattactgtacaactagccgaaattctttatatagttctccatttttaagtgtaactcaaagaaatatgctcaacataagcaaaattttcttcaagtaaaagaataaaaaacagttgttattgtcctataaatctaatcatggttttgttcattatacttcataaagtattttcaaatgccttatgccattaatgcttacaaaatgtctttgaggaaaatatggtagtattggccatcattatagacacagactgagtcctagtgtttcagttatttttgcctatgttggtagtaaagttgagattcaaccttggtatttttactcagcttagtattcaaaggtgaagttaatctttggtacctgttctctgtgaatcaaaatatttgcaataaatccacaagcttcaaaatgcagtatctttatgtaaactcaagtctttttaaggcctttccattttaaacttcatctattttccctgaagaaggtctacttcaacaagcattggctgtgtcctatgcatactagaaattatgctaggcatgattcgtgctagttctcaaatgttaaacaagctgtatcaggatcaactgggcaactgaaacaaacaaacaaacaaacaaacaaaaaacagcaattccaggcttacttctgaatgaagacatcagacttctaggttacagcatggggatatgggtagtaataaatttcaaatgatctgatcaagagccaaggttgcataaattaaaatacatttaaaaagaaaatataaaagaaaagagaaaatatctaggtggcaaacactgtggaaagacaaggcatattttgatttgaatcactgaaaatcacattaaatgagtgatttagaaaagaatggaggagagttgtgattcattaatttctatggcacagtttatttacggtgtttctttatttataatacatctcataatccacataatagaaaacttactcccaaaaagatttactaaactttggaaatatggagtacatgacataatggatcttaagtgcttagaccacagaaggcatttatattagtttgctaggaccaccataactaaatatctctgactggatatctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctgactggatatcttaaacaatggaaattaattttctcacagcgctgaaggctagaagtcaaagatcaatgtgccagcaggattggttatttctgagggctctccttgggttgcagacgaccgccctctttgcgcctcttcatatggtagtcccactgtaactgtgcacctctagagtcttttgtgtgtgcaaatttcctcttctttaatgggcaccagtcagattgaattagggcccacctttgtggtttcattttaacttagttacctttttaaaggacctatctccaaatatagtcacaatctaagcaactgggtgttagggattcaacatataaattttggagaacataattcagcccctaacagcttttaataaattttagttgctctgtgttttgtctgattctctacttacttctttatgtcacttacaggattccacacaacccctgtatctgctcagtttcatttgttgctgaaaggttatttgctgtaggaaatctgataacttgaaagcttgttattggagatgatttgtgtatttggggcttctagataaacattcacataaagaggaaggcgggagagtttggtgtttttaccttgaagagtgagtaggctgggaatttctcacaggttgcccaactaacaatggagatcctttcagggttggatgtttaaatggtctgtaaatctatcacatgcacaacttcctattggaactatatctaggtatggacctagatattctatgtgattgtttcagagtctgattttttactttttctgtattctagaaaattaactaataaatattttaagctgacattttaaaattgtaccttcttttccctgtggaaagaacattcatgctttattatttatgtgtctttctttccttctagctttcaagtttttcaaacatatatatctatgcttctttctgctgtcaactttagtgataaaaaagaatttttctcactgcttgtttaaattttcttcagtgagaattccaccacagaaacaaacaaacaaaacaattcaggaaatactaatgcagttttttttttaagtttaacattatgtatggttgtacatttcctgttaaattattatcaacttttcataactggttctgcccttcagcccttggaagccatttgcaagacatttctaaaacactatggaagaaatccagtaaagatagacttgtctaccaacttgacagtcattctttagaaatgcctttgggagagtatcatccattttcttcatttttccccattgagaaatgagctaaactaatttctactgcaatgttaactcatactttcatttcattcagggaacttttcaattacagttttacaaaggaaaatacaattttacgaaggaaaattgtaattttaccttcaggtttattatcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaagtaagtggatgcacatttttcttctctgttttctataatgacagagtcttggtatatgacatataatattactaaccctgactcaaggcttctattttagtgattgagcaattttgtaagttaatcataaagcctatttcattttttttttgaagtacctgtcacccttagtgctataataaaagaattctcatatttcccctctggaattaaaatttactttggatttatggaagttggatacattttaattataccactatattatttgtttacaggaatccacaatgtctgttgtatcctcagttaatcacaattcttgaagtttcacagataccattatcacactggcatgaatgtgtgacctaagaaagttagtgggttctttataatagcacacagaaaccagatatgatattgttcaaatgtagatgttgattcagtaggcctggaatggggcccaggcttctgcatttataacaagctttcaggtgataccaaactactaggccatcactttgagtagcaagattttggagtatatgaccctaatacatgaacagagctacagttagtaaagcatttctagtcattagctattgttttgtatgtatgcatgccaactatatatttatatttgcatttaactcacaaagatataactattgtttttcgttttcattgcagatttttgctgaaactgccttacattgactccaaaagattaagcatttttggaaaggtaaatagtagaaatgctgaatctatctttttatgcgtatctatgttatgtaatatcctattacacattcacaggaggccagttggttacagataagttccatattgactgggattccatacttattaacatggaaaacctcactgtagcaagatttgatggcagaggaagtggattccagagtctgaaatgtatatatataatatatgtatatatacatacatatatgtattatttgtatgtatacatatgtaattacatgcttcattatattataattcctctgtattatcctttaaaaaataacataattagtattatatacagtcagtcatttattaattcagtaactatttattgggcagttagttggcacctggtgtcagaagtagaacaacaacaggacaaaatggggctttgttttcatgaagcttgtgttccagagaggggaaacagtaaagaggtaaatgaaaaacacaatttcatatagtaataagcctcataaagaaaacaaagaaaaactgatacataaaagctaactgcagaagcgcggccagtgtcattagattgagtggtcaatttaggactctctgatgaggttatatttaaacctatacctaaataacaaatggacgctggtcaaataaatctcttgaagcagaatattctccacagaaaaaaactagcaagtatcgcaatcttaggaaaacagacacaggcttagaaactaggaaatgaccagtgtgcataattacgtcatctgtgctctctgcacgatatttacttattgcagtaactgttatgtcaggttcaacattattttgacagtgggaaaatagacctcatatagatatttattagtttgttttttatttttgttttttgttttgttttttttttttttttgagacggagtctcactctgttgccaggctggagtgcagtggcgcgatctgggctcactgcaacctccacctcccaggttcaagcgattctcctgcatcagcctcctgagtagctggggactacaagcacgtgtcaccacgcccagctaatttttgtatttttagtagagacggggtttcaccatgttggccagatggtctcgatctcttgacctcgtgatccgcctgccttggcctcccaaagtgctgggattacaggtgtgagccaccgtgcccagcctattgagcttgtttttaacacatcagtggacaatgtattataaaggtaaaaaggccaggcgcggtggctcacgcctgtaatcccagcactttgggaggccaaggcgggaggatcatgaggtcaggagatagaggccatcttggctaacacggtgaaaccccgtctctactaaaactactaaaaattacccgggcgtggtggcgggcgcctgtagtcccagctactcgggaagctgaggcaggagaatggctgatcccgggaggcagagtttgaagtgagccgagatcgagccaccgcactccagcctgggcgacagagcgagactccgtctcaaaataaaataaaataaaaagatgaaaggaaaagggggaccttgaactattttagtttacaaataaagcaaattcttggtgttcatggatttaaacatatgatattttctactattcataagtaacctagagatccatgacataaaataactggtaagtttaattggggcgtaaattttagtggtacatactgacaggtgggtgtataaaaaaccacttaagaaatgagtaaaatacaaatcagtgcaaatcacgaccatcctctctccacttcaaacatctgcagtgtatcatgcctttgcagcattctacacttgttgtcagcaatattcaacagataagtaaaaatattttgtgagcattgctcctccaacataacacaaagaagtaaataactgaaagtgcatccctagtagtaaaggttagttttttgtttttttttttaaaggaaaacatctaagaaagtgatcatcccaaagaaatggaaaccctagatatattaaaaagtgaaatgaaatcctgtctcagactgcagcactgttaagccttagggacattgtgctaggtgaagatagccagtcacagaaggacaaatactgtataattctacttattacatgaggtgtctagagtggttgagttcatgaaaaaaaagagtgaaatggttgttgccaggatttgaggggagaggaaaaagggaagctggtttttaatggatatataataatggcaagaatgtaaactagtaaagtaaaaaacaaagataaatagagaacaaccaagccagaaaatacagttcattgaaaaaaaagagagggatggaggggtgacaaaaagggagagcaagagcagtaaaggaagaatgtgagtgcaaatgagagcaaggtgctctttagtgattagccattttatgagcccatcagtttcttattagggttcttggaatttttgtctagtttcatatttgcaagatgaaaaagttctggaaatctgtttcacagaaacaaatatatacctgacactacgaaactgtgtgtttaaaagtagttaatagagtaaattttatatgttttaccacatacaaaaaagtacatgcagtagggaatattttactccttaaaagtcctgatacatgtaataatttacaaatggcttagggcctatgtatttcaatgctctgcttactgtacacataaataagcataaaggaccaaataagcttttacaaacattcatggaaatttagagaagattcaaagggttgtaaaatgcctcatggaaaagggcaacatgagctgagtggtgatcagcaggtagaggggaaggaaaagagtctcatgcaaatgcacagtgtcagtgaagggagcatgtgtggagaacatgaaatgaagtagttgactgttattagaagaatgataggcaataagaatgagaggaagactgggccgagacgatagaggatcttcattgccactgagaaattagaagctcagcatataaaccatggaaaaataacactctaggcttcacatttagaagttcaaattctttttccccaaatcgtcattgtatacttgatgtgcctcagagcaaatgactctggaaaactaaaagagtgacataggatacaaacaagtaaaaatatgaatgacttcatcttaaatggaaaaaatattccaggtcaaacaaatatgcatatctgtgactgagttataaattaaaagttgactttctcaccatgtaaaatacactgtttatcctaagattccgtagaccttgcgattcttttttcttgaaatgcactgatttcagattcaaattaggttatgctaacctcataaaacgggttggaaaacaatgttcttgctatactgattccctggaaaaatttgtttaaaattggaactagactataaagaaatttggagctattgctttctgtgtgggattaaacatttaattagtttttaaatttatgtaaccaatagaagactattaagattttgtttaatttcttctgaggtcacctttagtactttgaaaagaatattttttcacttcatataacttttcaagaatatatacaaacagcaatatataatatcctcttattatatgcttaatcatttcacttgtggcagtaatatcccattttgatttctattatgacttactagtgccttcttgcttttgctagggcactctcttgctctcatttgcactcatgttcttcctttattgctcttgctctccctttttgtctctcctccatccctcttttttttgttcagtgaactgtattttctggctggttgttctctatttatctttgattttactttgctagtttaccttcttgccattattatttttcttctactttttatatacattttttcatcaattattaagttgaatgtctagcttattaatttttcattctttctttcaaatacaagcacttaggctgggtttggtggctcacacctgtaatcccagcaccttgggaggccgaggtgggcggatcgcctgaggttgggagttcgagaccatcctgaccaacatggagaaacccctgtctctactaaaaatacaaaactagccgggcatggtggcacatgcctgtaatcccagctacctgggaggctgaggcaggagaatcgcttgaacccaggaggcggagattgtggtgagccgagatcggaccattgcactccagcctgggcaacaagagcgaaactctgtctcaaaacaaaacaaaaaacaaatataagcatttaaattaaaaatccttttgagatgctctctgaggtatttttcactactacagagtacttttattaccatatagtgaaaatatctatttgtcaggataagtctatgtcttctgaacttttcttattatttttatgtcaaattgaatgaaataattttttggtacttttctgtaacttactgactataattgaactgtggccaaagaattgatcaggataacaaaaatactttgaaatatcaattgatttatgagttagggagggaatcattgttttatctttatcaattatttaattttgtgtaattaattttcttattttacttgatcctgattagccattttatgagcctatcagtttcttattagagttcttggaatttttgtttagtgaattgatttttttttcttttttttttttatttcaacagaggtttgaggactaggtggtgtttacttacatgaataagttctttagtggtgatttctgagatttaggtgcacccatcagcagagaagtgtattgtacccagtgtgtagtctttcatcccttacccacctctcactttttccctccaagtccccaaagtccattgcatcattcttgtgcctttgcatcctcatagcttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatctttttcatataatgacttcttttcctctgggtagatacccaatagtgggattgctagatcaaatggtagttctacttttagttctttaaggaatctccacactgttttccgtagtggttgtactagtttacatttttaaaacttccatgtgtgcctaaaagtgttagtgttacatatatgtccatttaatcaaacatatccattttgatgttcaaataataaacattgattttcactatgtcctcaggaaggtgcattaaagtatccctttataatgtgaactcatcaatttctccttattaatttttctaagtacattttaaggctattattattcagttcctgcaactacagaattattatatcttctggataaatttaatcttttgttgtttttattggccaagtttatctctattaattttttgcattaaagatttttatattcaaattacaataacatccttttttcattgatacatgtttattatcagcctttccaccttattattttcagcactttccgattgatttaggtatgccctttaaacaaaaagagagagagagaaatatgtttttatctttttgccaatttctgtatttttgttgaagattgtattcatttaaatttcttctaattactgataaatttaaatgttactgttttcattatatgtgccattatctgtcctattatatttcttgtgtcttccatttatttgaattgattatttttttctctttcattcttttttctaaatataattttggtttgttcaattatattgctgagaagtattgtattgtatgactataaaataatttgtttatccattcacctacggatgaacatttgcattgtttttagttttgtgtatagttattataaacgtgtacgcttgtttttgtgtaaacatatattttcatatttatttgtaaatacataagagtagaattgttaagtcacatagtaattccatgtttacctgtataaggaatttccatactcttttgaaagtattcatactttgtattttatgttttaggaaccatataggagagtttcatttgttctacatttacgccaacacttaatatcatcagtcttttaaaatcatccacaactgatgaatagtgggatttattttattttcgtttgtagtttactgataactgataatactggacaccttttcatgtgtttattgcttcatataggtatattttaacataactgatttgttgaccattcagactgtgcaacttacactttcatattaaaatttactaagtcacagaaagcatgttacaactgcaaacctattccttccttccccttttcatcatttttaattgagatataattgacataccatgaaattcatccttatatcatatcttaacatcagatagtagtgtcttaaaatcaaatagtagtagttcttccatcttgttcttctttttcaaagttcttttaactcatctagatgtattacatttctttataaattttagaatcactttgtatcttttctaaaaagaaaatacaccatagggatttcttatgtgaattgtatcaaatctataaatcacctggcaaagaaataactgacatctaagcaatattgaagctttcatatttttaaaagataattttgtttggtgttctgttttttctagtatgtgcatagttatagatattttttcattaaccatgtttaggttgtattgggttttctgaatctatgctttggtgctttctgtcaattctagaaaattatcaattttctattagaatattgtcataacttctcatcctccttaaacacttattaaaaatgtgttaaaatctcactttaacatggttattttataaacttttcttggtgccttttggtatttaattctgtgtcatacttgcttctatagtccaataattctctcttcatgtgtgactaatggttttctatattcattgcttaaatttaaaaaaattgttactagaagtttcactgagctttctataaaaatgtttagctatattttaactcttgctttgctgatgtgtatttttaaaaatatatttagcatcattatctgatattttacatcttattaaacaaatatcttttatttttgagtattggtttcttttgcctgttatttctgctgtctctcagtcatggtgatacttttccttgtgtactgtttatttacttgtagatgagtttatctttcttggaattttatctatggggattctttgatgcttttgttgcatttgtatttatgtattatgttttatttttaattgtgtatgctgaattgggaccacacaaaccaagtgtggacttatggctcaaatttttagtcaatattaattattttttattagctcagtacaagctcataacaggaataaaaattaaaacatctcaccaatctcttttatgcagcatgggcttttattttttgtcacatttagacaatgcttttgggatctagatttatttagggtctcctttagacccattgtggattttgtttacgccatccaccaaagaaggcattagaacgaaaggtcaaacaaagtctttagcatgtgaataaaacattggtttcatgctttatttttcacgtttccagctttcagtttgtatttggcttttgtggatttatgagatttatttttagtgtttggggttgtgcctttttctaaagccaccaacttatatttgtgttttatttatttgtttggttggttggttttactttggttttctttagttgagggatcaagtggagtatctgtttcacttaatgctggaaaagaaactgccataaatatgttgttctcatcaatgaggctgaaacaagtcttccttgtaagattctaggctaagttaaatctcaatgtaaaaagcgatgtgattcatttgagatatttcctcaaggaaagaaaagatgattggcagctctagttctaggaatttgcaatttctagtcaacttcttttctttacactcactaatatttgaatgaatttccaggttctgctttttctccttttggtctaagatttaccatgtttttatgatgatatatatctatatctagctagctaaataatttcattcattattatggactttgccagcaaaaactaaacttacactctgagatacatcatactgatatatatacacctccataaagccaaaattatgaaatttaaaaaaatgctcaatgtttttgtcgtgtgtataattgtttagtttaattttttgcttttgagtatggaaatgtttaataaggagctgggatttggcgatggctgtgaggcacgttctttttttatttttaatttttttaaaattttacgttaagtaccacggtacacgtgcagaatgtgcaggtttgttacgtgggtatacatgtgccatggtggtttgctgcacttatcaacccgtcatctaggttttaagccctgcatgcattaggtatttgtcctaatgatctcctttcccttgcgccccaccccccaacaggcaccagtgtgtgattttcccctccctgtgtccatgtgttctcattgttcagctcccacttatgagtgagaacatgcagtgtttggttttctgttcttgtgttagtttgctgagaatgatggcttccagcttcatcaatgtccctgccaagaacatgatctcattcttttttatggccacttcgtattccatggtgtgtatatgctacattttcgttatccagtctatcattgatgggcatttgggttggttccaaatctttctaatccattctaatcagtgttctttaactatgtaaagtgattaaggaatagaatgatggtatttctaagaatagtctttggtcacataatatatattttttagacaatactactacctcttttctatgtattaaaatgttagtcctataaacaccaggaaagcattgattaaattaattaccttctaaacctattacatggatactagaggaaaagagaagagaaacttcagtcagtacaaaagcatagatgtcaacttttgtctttttacatccaattttatttcaatatttcacaagtattcactaaattctaaaagttgcaactattacgtaaaatgggacctaatgatatttcaactgcatttactgttatttactttccaactgcattttctgcaatatagtttaactgaaatctctttgattataagcatgcattccacctttctacctcagtgtctttgttcatgccttttaacttttttctaacagcctctaagcctacatattgctttagaattctatctcttattaagccctattcaggtgtcgtttcctccattaaccattcactcaatctctcccactggaaaacactattccctcctgtgtactcatagaacactttttagtagcttcttgtaatcattataccagtatgtaatgtattacattcatttgtgttctgttttcatttctaagtcagactgtatgctttgtcaagttagttcagttttatttgatttttttgttgcagagacatttgaattgaacttatttcataatctttctttaatttggaattccctctccctctggatatccaaactttatccttttttcaaactccaattcaaacctttcctattctgaaagtctttacctcaatttcacacatagaatgttctataaatatcaatgaagccaaggtgattgaatgtattattcaagctttttatttctttactgattatctgtctactttttctatcaactaatgagagagggtgttgaaatgtttggctatgccataagacaaaattacaacatcttagtctaaaaatcttaattgctttatttgcaattctagaattgggcaagacttcattccatcaaatagaaaaagtgtcccaatgagctgggcagaagaggctggttttatagatagaaaagaactaaagaaagaagtaacaaaaaataaaaagcagattggtcatttcaaagttactttgtgaagcaggaacagttgaaaaataactggtagcatcaggtcacttgaggttacattttgttgtcagaattaaagcagaggaaacatcattatcatgctgattgaaactggcctgtttgggaaattaggctgttaacctcttactcctgctttctaggaaggtcaagtaacaactcagtttgggtttggtgacatggaaactcagcatgagtggctccattttgatttttagtctggtccgttgaggcctagtgcagtagcttagttcaaaacaatgacttcctacaatttttatttaaaggctataattgtctgtttgccttttcctactttcagttctatcagttttggcttcatttatttccatacttttttattgtatagatacatacatgcttaggatcattatttcctcttgattagttgacctctttattgttaagaaatgaccttggccgggcatggtggctcacgctgtaatcccagcactttgggaggcctaggtggctggatcacctgaggtcaggagttcgagaccagcctggccaacgtggtaaaacaccgtctctactaaaaatacaaaaattagccgggcatgatggtaagcacctgtaatcccagctacttggaaggatgaggcaggagaattgcttgaacctgggaggcagaggttacagtgaacaaagatcatgccactgcattccagcctgggcgactttatttttggttatattatctcctttgaaatcttttttgtcagatattaatatagccactccatctttctttggattattgtaaacatgttataaatcttactccattgtttttctttttatctatttgtgtatttacatttacgtattacgtatttatatttaaagtatgtttcttataggctgcaaagagttgggtcttgcttttttattcaatctgacagactctgcatattaaatctctagattttaaataatgtatttagctctttcacctttaatgtaatcattgttattgttgcattaaggtctatcatcttgccatacactttccatttcttctgcttttagtttctttaaaattttgtctagtgtgctttatattaaaagagcattttttataataaaatttgctttgttatttgttaattataactggtctttgcattattttgatggttcctttatggcttataatgtatatttttaactaattaaagttgtcctcctgtgatattattttacttcactcttcaaggtaataagctgtaaacaggtcagtatttatgtatgtatacacatacatatatacacatacatatatatacacatgtacatgtatatgtatatgtatatgtatatatatgtacatatatatgaagtgggatatatcagaggagggcaactgtgtgtgtgtgtgtatgtgtgtgtgtatatatatatatatatatatatatatatatatgctctacagtggtatacttctgtttctctatttctgacctttatgccacagttgtcatacattttatgctacatgttataaatcccaaaatatattgttataatttttgcatttaaaagtcagttatttttatttttatttttattttattttattttatttttttgagacagagttttgctctgttgcccaggctggagtgcaatggtgtgatctcggctcactgcaatctccacctcccgagttcaagcgattctcctgcctcagcctccccagtagctgggattacaggtgtgggccaccatgcccagctaatttttctattattagtagagatgggggtttcaccgttatggccaggctggtctcaaactcctgacctcaggtgatccacaagcgtcggcctcccaaagtgctgggattacaggcatgagccactgcacccggcctaaaagtgagttatttttaaacaaatttaaatatagtgtttaaatgtttatatatttacccaggtgactaccaattccagtgttcatcatttctttgtgtagatacagatttccacctagtctcactttttcttctgcttgaagaacatcctttaaattaccttgtactccaggtgtgcaagtagtatattcttccagctctaatgtgtctttattgcactttaatcttttaaatattttattattttctgggcaaaaagttttaggttgacatttcttattctatactgtaaagatgtttactaccttctggtttgcatttttttcaataagaatatgccatcattcttaacttttttcctctgtatacaacgcatcttttctctgtagatgcttttaataatttctctttatgattaattttaatgaatttcattgtgatatgccttggtatagttttcttcatatgtcttacgcttcagtttattgaatttcttgactatctaggttaagtgtttttaacaaatttggaaattttttattattatttcaaatattttttgttgtccactttctcagggattataaatatgggtagattgggctacttgaagttgtccccaaactcactaatatgctgttcaattttttttttaaaagcatgcatttctttgtatgttccatttcagatagttctgctatgcctcaacttcattcttcaaggtagcaagctgtaacaatgctaggactgacgtgtttatttttcatcattcagggatcaatgtccttcatcagtcaatgtccaatgtcctaaaaacttctattttatatattttgtctatatttttagtcatttcatgtgggaggataaatctcatttctgctgcttcatcacgttggaattgtaaacttttaaataaaataaattgtatatttattaaccattttatatgtctctttttggattgtccatttatccattatatatgcttagtttattttgacttctggtatatatgaacatatatatttgtttccttgttgacatactaaaattttgctatattaaagatagcagtctctgttcacacttgtttgaaatatttcctcagctgcttgaattttgttaaaatttgcatatgatgaggcaaaaaactgaagttctaaaacttggcaaactcttctcaaatgctttcttgggtaatttcttccagtgattttattatttagatgtcctgtttctatcaaaaggctaaatgagtatttattatgttttctctttatttatctgagtttaatagagatgagagagatgcatagcacttgtgaggtatggtgagaatttacttatatagtttcaaatagctagccagtttcctagctccgttggttgactaaatcaacatcattaacagtgataccaactaagaattaagttctcattcatttcagggtttatttctgttgaattctgtctttctgttcttatgctaatcttacagtcttttaattataacatgcttcattataactcattttaatatttttaaaagaattttcactctttacttctctctttgaaaatattcttggctcacctgttctattatctttgtttttttcaaattctcccaaaatatgcaactggaattttttaattaaaatttgtttcaacagttataataatttaagaagaattaaaatagtcacaagatgtagctttcatctgagtcagacaatatgcacagtacatttcttttatttctttttttatatatcctagtagaattttatagctttcttaaaatatgccaaatctctctcctgctgcttttatttctaactattgcttattatttgtgtgttttaatttttattgtaaattgtgtcattttctcagtgttattttctaactagcttgttgggataatggaaaggttatgataatagcatatgtagcttttagctggccactgtttattacttattaattatggatatgacttgattgaagacattaagcaactttagtttgaataattatcctcaggacctaacctcatttaatatataataattttaattttttttaagaattatgtgtaagtgctaaatataaaacaaaactcctagaagcaaaattttatggacatagcttctttaaaaacattaatcacagccgggagcagtggctcatgcgtgtaatcccagcactttgggaggccaaggtgggtggatcacctgaggtcaggagttcgagaacagcctggccaacatggtgaaaccccgtctctgctaaaaaagtacaaaaattggctgggtgtggtggcgagtgtctgtaatcccagctactcaggaggctgaagcaggagaatcgcttgaacccagtaggtggagtttgcagtgagcccaattcccaccactgcactccagcctgggcaacaagagaaaaattctgtctcaaaaaaaaaaaaaaaaaaaattatcacaagaactgaaattaagtttagttgtcttataaacatttttttttagaacagatatcactgtgattaccaggccaaaaaaagattaattcatccaacaaacattattgaatgtacactatgtgcccagcactttttttgaagtgttggaaatacagtggtcaaagagtagaagaaaagtctttctttactgaatttagttcagtaaggagagctatatggaaaacatgtaaactaaacataattggtgaaatacataaaatgtcagatggtgagagtttgattccaaaaagtaaagaagagaaataaataaggatgccaggattagagtgaatgtggccaatttagattggaggtaaggaaaggtatcactaggagatcatgtttgaactaagagaaggcaatgtaaggagataagaactatggatatctggggaaaataaaacaaacttaaaaatgtaaatgaatatgaaagcttcttaaaactttacttagggaggtaattatttgttatgtaaagttttgtatcttttcaattgagggagggcctctcagtgtttgagtccagcttgagtcacttctaaggtttaaagcttcagtatacattatctgcagaattaagatcctgcctccttgaggcaggattaagattctgcttcaaggcaggattataggtattgtgataaaatgtgagtgattatgttaagcgaattaatagttttaatgcaaaataatagagtgtaataaaatttatcttgtatttataaaattctttatttccaattaattcattgtgtaccacaagtgaaatggttcagaaagaattacacaagtttaaattcgcacagatcacttctttctttctttctttctttctttattttgagacggagtcttactcagtcgcccaggctggagtgcagtggcgcgatttcagctcactgcaacctctgcctcctgggttcaagcaattctcctgcctcagcctcctgagtagctgggattagccaccacacctgactaatttttgtatttttagtagagatagggtttcaccatgctggtcaggctggtctccaactccttaccttgtgatccgctggcctcggcctcccaaagtgctgggattacaggcttgagccaccatgtccggcccaaataacctcttgtaaaatcccagtctgtcagtgtatcccttttactatattcataaagtcatttaaagatgatctgaaaacctggggccacagcaaacataaattttgagtaaatggcattgcagatcccacctctgcttctccaagtccttctatctattgaatttagtttcctacatcatgagtatatttcttttaagaaggaaaattctaaggaaacattcctatattttaggcttactaaattaaatttaaaaataacataaacttgttaaacttttgtaagtaatgctaaaatgcttggcaaatgggaatgacaaaacaattttaatgaatagcaaaatccgatcacgggaagaccaataaaatgcacaatgaaaacagagcagcctacactgatgatggaagtttttgatctttattaaatcaaaagtagcctctaatttactacagacgatatggtgattcccattttttaatctacctgatgatatgcattgttttgaaagttgaaagcgttcttatatctacctagaacttatatcttatttttgccctcctctgaagtaaattttccaaaaactcttttgtgatatactattgcattctgtaaatacatataaaacaggtgagaggaaggcgagccattaaaatttaacttattttcatctggggctggtggggcacacctgtaatcccagttctttgggaggccaaggcgagtggatcacttgagcctaggagttcaagaccagcctgggcagccatggcaaaacctatctgtacaaataaatacaaaaattagctgggcacggtggcacgcacctgtggtcccagctactcaggaggcggaagtgggaggtctgcttaagcctgggaggcagcggttgcgatgagcagagattgtgccatgtacttcagcctgggtgacagagtgagaccatgtctaaaataaataaaattattctaatttttgccagtgtcgatttttgtttaaaaatcaattaaagaagcatttgtggttcaattttaaatgctataaatagaattttattcaacagcttttattatcataaagacttagaaaatatttggcttcattaaatgccaaattttcatatttacaaaaatagtaaaatataactccttgtatagcagcaataatttacattcctggttttactgaagaatcacatggggagatccatcaggtgcccattctccacagattgtgattgaatgtgggtcggggagagcactggcactttttttttttaaagcttcactcatctagggaacatcggctgggactaagaagatgtttccggtaggcacctttattatacaattatgcagtaataacttgttgtatataatgtagatcagcagcatagaggtcccctgagagtttattaaaaatgcacaatcttaggtcccaccccaggtctactgaatttgaatctgtatgctgacaacactctcaagtgatttgaattaagttagaagttaagaagcattgttgtgggatctacccctcctttggaaggcactattcctgattcctagagataatcaggctatgagagacatgtgaaactgagataaataaaataaaacaaaccaacaaaaacatataatgtcatcttatatatattatttaaatgtaacataagcttttatggactggaatattcattattctatcaatgttttcaggttatataaacaaacatcataatcagctgaaagtttgcttggccatcatggtattgttaatagaaccagaaaagttgcatgcatcagctaagatgtgtgatgcattcctcactatgggaagagtcttgcctacgggaaatacttgaaatctcttggctgcaacacccttcgcccatctttatgacagagaactaggaacaatatactggaaatgctccctctagggacaacactttcaagagctgtttccacttttgctttatgatacaggttcaacgtacctaatctgaaaatccgaaatttgaaatgctccaaatccaaaatgttttgagcaccgacatcataatgccacgcatggaaaattctacacctgaccctatgtgatgggtcacagtcaaaaatgccattaaaactgtttcatgaacaaaattactaaaaatattctatacaattactgtcaggctgtgtgtataaggtatattaaagcatatatgaatttcatgtttagacttaagttttcatccctgagataacacattatgtgtaggtaaatatccctaaattttaaaagaatccaaaaatcggaaacttctgaccccaagcatttcagataagggatattcagcctttagctatttactttcttgctttgcatagcttaccccaccttcttatttttctttcttaggtaggttaatacatttacctacctaagggaaaatttaaaatgggctacttccagattttgctggcctaagactgtctctctcaatgagaatgagcaaaggcactttgaagtagcttatatctatataggataattttctttccttcagttactaatcgttaaagctttgctcaagcttctgagtactatctaaatattccagtaccagaacaatatatgctatctcagtccattcagtaatgaatgactgcattttgaacttttatgtaccaatttttaaatgatgctccaaatacacataaatgaaattctttatttcttacttcaagagtttagtgacaatgacaataaaactataacctggaccacacttgagtcatctgaaaatctttcaaaagtagacttcatcatgaacaaactgcatcagaatttctgagattgaggcctgaatgttaatattttttaatacctcccaagatgttctgatttccagtagcataaagaacattactgagagtagggctgaaaattaatttctaaaacagatagctcagtaggtcatttttttttttcagcattactgtaattattaaaatctcctctggaacttttctagtcagatcttggtctacaaaagaaaactggacatcttggcttattaaaaaacatttcaagagggtattcaaaattaaacttaaacaataatttaactcatctatctgggaacattattcattatatcccattgctttccaaaacttagttgtgtggaatatagagaagacaattttctcctttactcttcatgagtttttagctaagattccctgcaacaaaaggcagattaacaggagaaaaacaagccgggcgcggtggctcacgcctgtaatcccagcactttgggaggccgaggcgggtagatcacgaggtcaggagatcgagaccatcctggctaacacggtgaaacccgtctctactaaaaatacaaaaaaaattagccgggctggtggcgggcgcctgtggtcccagctgctcgggaggctgaggcaggagaatggcgtgaacccggggggcggagcttgcagtgagcccagggggcggagtttgcagtgaacccagggggcggagcttgaagtgagccgagatcgcaccactgcactccagcctggaccacagagcaagactctgtctaaaaaaaaaaaagcaagagaaaaacaaacagaagcttaataacataaatacctcctttgtacatgggatagaaacaagaaaaatgggcagatctctagagtagatctcaaagaattgtcttatacctcagatgcaaacactaccattctctgaaacaaaggcataaggatgtaggaaaggttttgttaagaaagatgaccaggaaaagcaaaacacaagcaaagtttgtcacgcatagtgaagtcgatttcttctccattgattgagtcttcggttatgtagttattcttctcttcctggtgcggaaagagagggagagaaagagagagagagagacccttgaaaacatctatacatttcctttatagacataaatttatcttacacaagggaaacttccagccttgtttctagtattcttcctgtgtctgcagtttctcaaaatatctagctccaaataatcctaagccagagaggcatatttagggtgaaatagtctgagtgcagccttattttggggtgacatgttctgaactctataagaaattaaaacaatctaaatttttggtgagatattttcaaaatttcattatttcttaattctacataatcatcattatttcagtattttattaaattagtggaaaattacatgtgatttaataagtgctttatttccctaacctcaaattatttggggcaatttccagatgtatagtatgaaatcatggagcaatatttgacatttggtgatgtaattaattttatattttacttaaggcttattaaaacagctgttatataacaatttaaacaaatgttcaaaaatcttaattgtacaaaatgattttggcttttttcccccaagcctgagacattctgatatgatgtacagtaccaaacattgatcaaaagctaaaaatgtctccaggcatagttgttatatataaatttgtgtgtgtgtatgtgtgtgtgtgtgtgtgagatatatatatatatatatatatatttttcccccccagggttatggtggctatattgcatcaatgatcttaaaatcagatgaaaagctttttaaatgtggatccgtggttgcacctatcacagacttgaaattgtatggtgagtactttctacagactgacctagtataatgtattgatttgtagaaaacgaaagcccaatttagaatagctcaattgagctcatttatcatatgttattagagcctgttttcagctgtttatctcctccttgattcagctgattttactaaagcatgacaattaaatgtaaaatgaagaaattaatgaaatatgccagtcaaatagtttttagtttcttctcgaatgtctgttttcttgggtcacagcctcagctttctctgaaagataccttgggatgccatctaaggaagaaagcacttaccaggtaactaatttgaaaataacaaagaaagaggagtatttttgttctaaaaaattagttaaatggcttatttagatctatagatacagatatttgtattttcctttataggcagccagtgtgctacataatgttcatggcttgaaagaagaaaatatattaataattcatggaactgctgacagtaagtattatacttgccgctgctgtttgatagggtatgaccttttacaaagggatacatctaaggacttgcttacaggaagccctgtaaaccttctgaagaagggagcagagagtcacacaaagaatcagatacatgatagaaggtgggaaaaaagaattcagagataagaggagaggaggctattcctcaaatggcagcgttgtccaatcaaactccctgtaatgatggaaatactttatcaatgttgctgaaaaagtagccactggccacttgtggccataccttgtttagtgtgactgaggaactgaattgattttatttaattttaatttaaaaaggcacttgtgtctagtgactatggttacagtgttattcagcacacctaaaatggaaaccaacctggaaaacagaaaccaaaaagctgcaagcactgacatgaaattctaatgaggttacccgcttaaatgaacttaaaaactttaaaaaggcactttcatatcatctctcattttttcatcactttaaaccttggaggtggatgtgattgatgttagtagtaataaataatatcattttatatttacatgacactcttagggaccaaagaatctatattttattatcctctgtgatattttacaacagacagctgaatatttatagcttcattcatggatgagaaaaatcaatttcaaaaaggaaacagatttatccaaggccatctggcaagtgagacaagaaagtcaaagtcttgaatcaatatttcctaaatcttgaacttaacttcttcctctttagggtgggttccactgaatgatttgcttcaagggtactatatggaaaaagagagaaagaggaactttacagtggagaaatttgacaaacatcacatcaacagtgacaagtcatgttattactgttattaaatgcccttgatatgatgtagtggggatggcactttacctccatggtttagtactccaagcccatacataacaccagtctaaccatgagaaaaccatcaggcagatccaaatgaggaaaattctatcagatatccagccagcacccctcagaactgttggggtaatcaaaaaaaaaaaaagtctaagaaactctcatagaccagaggaagtttaaaagacatgatgtctaaatataatgtgggattctgaatggaaccctggaacagaaagggtacacaggaaaacaacaataagaacaccaacaagaaaaactagtgcaccccaaataaagtgggtttagttagtggtagtatatgagtcttagtttctatttgtgacaaagtatataataatataagatgttaacaatggggaaactggaggacgggtatccaggaactctgtactatctctgcaactgttctgaaaatgtaaagcaattatagtattaatagtctattaaagaaagaggtagatgatacagtaccagtgttgggtgaaacatgatgaaagagagcgtaaaaattttgagggacatttggatgttgttctaaggtattaagaccttacatatatatcaacagtaataaaaataaatagcaattatgtactcattgtatgtcagaaaatgtgctaaaagcatttaatattatcttatttgtacttcttgcaaacacggaatagtagatgttattactttcatttaacagattgggaaaataaatattaggaaatgatataacttccttaaaagagtagacacaattgattagtaggaaggagatttgaatccatgtattgagccttttattcactgtgccctgaagccttattcatatgaataaattatattcaaggttaaattattgtatgtctacccatcatgctggactaatatattagtgctatttcaaatttctctgtcaatatgttgtagctataaaggtaaatcattgttctatctgactcactcagtcacaggcctggcgcttcacccatctaataaaatacaagcagaggttcagccctggtccctggagaggaaatgcacctgtgaatgtgtgtgagcacacacacacataggcacacacacacaggcacacacatacacataccacacaacccatacgggcctggtgaattataggtgctcagtcatgacactgtaacaccactactattaatattatcttcaaaaattaccagcaaatgaattcaatcacccagtcaaacctgtaatgttcccttttagctatagtaaacagacaaatagcaacaaatatcaatggactttgcattagaaactaagcagaaaaaaaatccaattggaaaaatccttttgcacatttattttcagctgtctccatgcagacaaataagggatcacattacctctgtcattgaccttattaattagcatttctagaagcttacatttatagagcagtttgtacttatgtagcaatgacaaggtcattttcccattaagtgccataggaagatgttgaaaaagatcttgactatctagttttttaataggtttaaatgattgtttgccattttacattctctgctgtgtggtctgattattcagcattctagagttagagcattaaagaggcttaaactattgataaggctgccctaattttgcaacgacaattaaaaatgttagcttaggctgggcgcggtggctcacacctgtagtcccagcactttgggagaccgaggcaggcagctcacgaggtcaggagtttgagaccagcctgaccaacatggtgaaaccccgtctctactagaaatacaaaaattagctgggcatggtggtgcacgcctataatcccagctactcaggaggctgaggcaggagaactgtttgaacctgggaggcagaggttgcagtgagccgagatcgtaccactgcactccagcctgggcaacagagcaagactccatctcaaaaaaaaaaaaaaaaaaggcagcttaaacatgagttacagaaatctgaagatacacaaactacaggaatgaacaccctagacagaatgtgagccaacttctgcagaaagagatttgagtgactgcaccaaatcttcatagctaccaaacccatggctattgggctgcttacttcagaatcttggatcttaggttctggcagaaggaagataaagcaagagtaaccagtatgctctatattaaatagttagtccttgtataatgagatgtgtattctattttctcagtatggggtattcttttctaattttgaataataaagcagaatgccagtatccaactgagactgtgccctagtaatcttcaaaatgaaatagatagctggtttcctgtattaatatccagaaaagacatttgccatattaaaattttttataaattttataaaatttataaaaatatgtgtaccattaggaataataaatactatccagtaaagtaaatataaacaccattctgtagagtaagtaggacttagttgtagctactgttttgcttttttgtttaatagagtgaagctcaaagttttaccattgtatttgtatttaccagctttctacctaaagccagatataaggttttttggttttttttttttttttttttttgagacggagtcttgctctgtcgcccaggctggactgtagtggcacgatctctgctcactgcaagctccccactcccgggttcacgccattctcctgcctcagcctctcgagtagctgggactacaggtgcccgccaccacaccggctaattttttatattttttaatggagatgggatttcaccgagttagccaggatggtctcgatctcctgaccttgtgatcggcccacctcggcctcccaaagtgctgagattacaggcgtgagccaccgtgcccagccagatataagtcttttaaatgtgcaatgtatgtaaaataaaacactgaatctctttgaaaaataatatgaaaaagttctcatacaagcagtgtgtttcttcagatatcataatttgatttcttgcagcaaaagttcatttccaacactcagcagaattaatcaagcacctaataaaagctggagtgaattatactatgcaggtaagctactttcttagaagaacgtgttttcctgctgtgttttttcacttgtgagatacgcaacacagcttctctattattccattctccctactattattttttaatatgttttttagttaccaaagattgtgttctctgttcctgattacaccgagaatgtggatgaactcatgctttacaagtgaattgcatgaatcctttctaaattgtcattttcctctcagacttattcatatcccaaatattgaattcttttaaaagtaacaagtttctacttcccttcttgttccttttatcttttcttccttttgttgttcctttcttccttttcttgttccttttgtcttgttcctttgtctttattattaaatatgagagtttattattaatttatttttaaatatgataatttataattctcataataaatagtggataaaaaatgtttggggaaatattacaagaaaagaagagaggataaaaggccatttgcactaccatttatgtctgtgcattcatacatttaatatatatttatcaaggacattacagtggtcactctgctctatgagtaacaagacatacattacactgtcaaggaggttccagtctgatataagagtcatagaaggaaaaagtaaagtcatttaaatttctcagcattcagaagaaccaaaagttgctcaacctgtctaaaacacaaactaccacgtttaggataatgaaatatgaagctatacagataaacaaatgtcaggtcattccataagcaatgttgaggagtatggagttttattcaaagggcaatgaggcgccatttaaacctttgtactcaggaattaatgggataatatttgtattttttatttgtattttagaaacagtaacaattttgtttacattggaaagggaattgtcaaagtaaataattgcaccagacaatgttaaagaggcaaggaagaccttatgaaaaactactgcaaaggagacaaagactgaactcaatgctctttaaataaagagctggaaagttttctaaactaaatactcctaaaaaggggaggagaggccaagggcctttagtcaaaaagaaactgtccaaagtttagtcaagctgagggcaaggttagtccatctcagtcaacataaacatgaaaaagtctaccttttatggccaacatattctaatttaaataccaaatattaattgacatgattacaattgttttaaaagtttagcatgaataacttagagtagaattaggtttgattttggtcagatattattactcaaagtttccatgacgttagggctcagaaaatgaatgcgagagacaatagcttcttggataatttgaaatcttctttctcctcaatatcttaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa
